US012648970B2

(12) United States Patent
Chabu et al.

(10) Patent No.: US 12,648,970 B2
(45) Date of Patent: Jun. 9, 2026

(54) COMPOSITIONS AND METHODS OF TREATMENT COMPRISING TUMOR-TARGETING BACTERIA AND CHEMOTHERAPY OR IMMUNOTHERAPY AGENT

(71) Applicant: The Curators of the University of Missouri, Columbia, MO (US)

(72) Inventors: Chiswili Yves Chabu, Columbia, MO (US); Bakul Dhagat, Columbia, MO (US); Robert Kazmierczak, Columbia, MO (US)

(73) Assignee: The Curators of the University of Missouri, Columbia, MO (US)

( * ) Notice: Subject to any disclaimer, the term of this patent is extended or adjusted under 35 U.S.C. 154(b) by 447 days.

(21) Appl. No.: 18/042,070

(22) PCT Filed: Aug. 18, 2021

(86) PCT No.: PCT/US2021/046582
§ 371 (c)(1),
(2) Date: Feb. 17, 2023

(87) PCT Pub. No.: WO2022/040365
PCT Pub. Date: Feb. 24, 2022

(65) Prior Publication Data
US 2024/0009252 A1     Jan. 11, 2024

Related U.S. Application Data

(60) Provisional application No. 63/067,144, filed on Aug. 18, 2020.

(51) Int. Cl.
*A61K 35/74* (2015.01)
*A61K 9/00* (2006.01)
(Continued)

(52) U.S. Cl.
CPC ........... *A61K 35/74* (2013.01); *A61K 9/0019* (2013.01); *A61K 31/337* (2013.01);
(Continued)

(58) Field of Classification Search
CPC .... A61K 35/74; A61K 9/0019; A61K 31/337; A61K 31/404; A61K 31/4166;
(Continued)

(56) References Cited

U.S. PATENT DOCUMENTS 8,282,919 B2 * 10/2012 Eisenstark .............. A61P 35/00
435/252.8
8,916,372 B2 12/2014 Bereta et al.
(Continued)

FOREIGN PATENT DOCUMENTS

WO      2018/217237 A1     11/2018

OTHER PUBLICATIONS

Kazmierczak, Robert A. et al., Evaluations of CRC2631 toxicity, tumor colonization, and genetic stability in the TRAMP prostate cancer model, Oncotarget, 2020, vol. 11 (No. 44) pp. 3943-3958.
(Continued)

*Primary Examiner* — Robert B Mondesi
(74) *Attorney, Agent, or Firm* — Stinson LLP

(57) ABSTRACT

The present disclosure relates to a composition of a biologically pure isolate of the genus *Salmonella* comprising archival strain CRC1674, wherein the isolate further comprises a disruption of at least one gene selected from the group consisting of aroA, rfaH, and thyA and a chemotherapy agent, an immunotherapy agent, an androgen receptor antagonist, or a combination thereof. The present disclosure also relates to the method of use of this composition in treating cancer, particularly prostate cancer and pancreatic cancer.

20 Claims, 29 Drawing Sheets

Specification includes a Sequence Listing.

(51) Int. Cl.

| | |
|---|---|
| *A61K 31/337* | (2006.01) |
| *A61K 31/404* | (2006.01) |
| *A61K 31/4166* | (2006.01) |
| *A61K 39/00* | (2006.01) |
| *A61P 35/04* | (2006.01) |
| *C07K 16/28* | (2006.01) |

(52) U.S. Cl.
CPC ........ *A61K 31/404* (2013.01); *A61K 31/4166* (2013.01); *A61K 39/0011* (2013.01); *A61P 35/04* (2018.01); *C07K 16/2827* (2013.01); *A61K 2039/5156* (2013.01)

(58) Field of Classification Search
CPC ........ A61K 39/0011; A61K 2039/5156; A61K 2039/852; A61K 39/0275; A61K 39/3955; A61K 2039/585; A61K 2039/884; A61P 35/04; A61P 35/00; A61P 37/04; A61P 43/00; C07K 16/2827; C07K 14/255; C07K 2319/03; Y02A 50/30; C12N 1/205; C12N 9/1007; C12N 9/1092; C12N 15/74; C12R 2001/42; C12Y 201/01045; C12Y 205/01019
USPC ......................................................... 424/93.4
See application file for complete search history.

(56) References Cited

U.S. PATENT DOCUMENTS

| | | | |
|---|---|---|---|
| 9,795,641 B2 * | 10/2017 | Nardelli Haefliger ...................... A61K 45/06 |
| 9,861,621 B2 * | 1/2018 | Saha .................. C07K 16/2818 |
| 2009/0220459 A1 * | 9/2009 | Fensterle ............... A61P 37/06 435/253.1 |
| 2019/0070233 A1 | 3/2019 | Yeung et al. |

OTHER PUBLICATIONS

Liang, Kang et al., Genetically engineered Salmonella Typhimurium: Recent advances in cancer therapy, Cancer Letters 448 (2019) pp. 168-181.

Wang, Cheng-Zhi et al., Strains, Mechanism, and Perspective: *Salmonella*-Based Cancer Therapy, International Journal of Microbiology (2016) Article ID 5678702, 10 pages.

International Search Report and Written Opinion dated Dec. 21, 2021 relating to PCT Application No. PCT/US2021/046582, 11 pages.

* cited by examiner

Fig. 1A
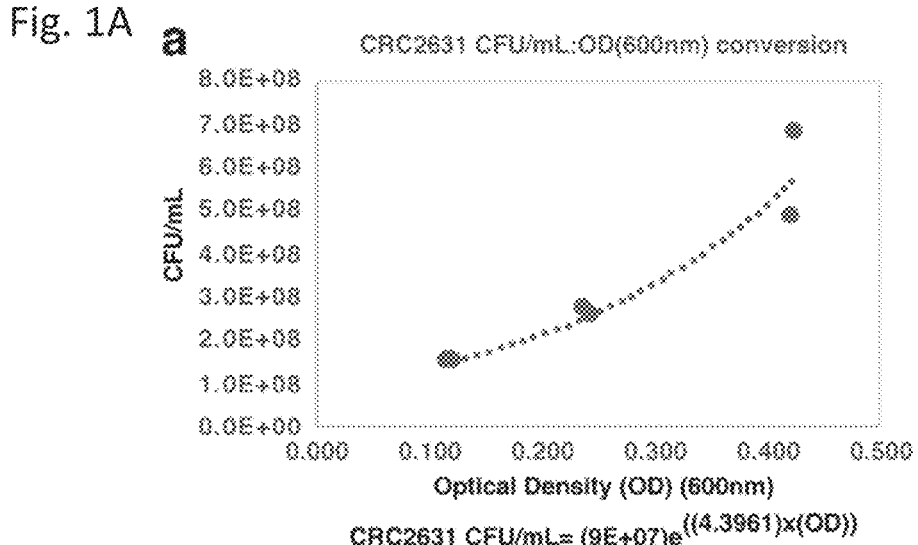
CRC2631 CFU/mL= (9E+07)e$^{((4.3961)x(OD))}$
Fig. 1B
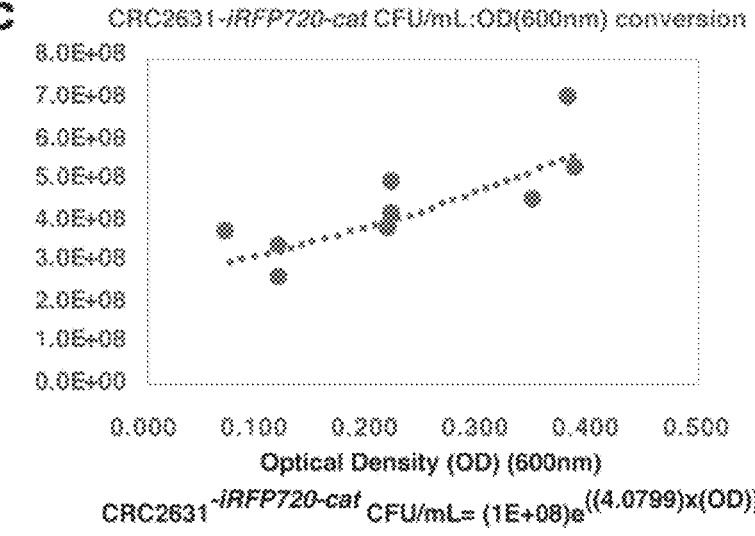
VNP20009 CFU/mL= (2E+08)e$^{((4.093)x(OD))}$
Fig. 1C
CRC2631$^{-iRFP720-cat}$ CFU/mL= (1E+08)e$^{((4.0799)x(OD))}$ a b e f NCI-H660 Cells

COMPOSITIONS AND METHODS OF TREATMENT COMPRISING TUMOR-TARGETING BACTERIA AND CHEMOTHERAPY OR IMMUNOTHERAPY AGENT

CROSS REFERENCE TO RELATED APPLICATIONS

This application is a Section 371 U.S. National Phase Application of PCT/US2021/046582, which claims priority to U.S. Provisional Application No. 63/067,144 filed on Aug. 18, 2020, which is hereby incorporated by reference in its entirety.

STATEMENT REGARDING FEDERALLY SPONSORED RESEARCH OR DEVELOPMENT

Not applicable.

INCORPORATION OF SEQUENCE LISTING

A paper copy of the Sequence Listing and a computer readable form of the Sequence Listing containing the file named "0800528.018501_ST25.txt", which is 6,438,095 bytes in size (as measured in MICROSOFT WINDOWS® EXPLORER), are provided herein and are herein incorporated by reference. This Sequence Listing consists of SEQ ID NOs: 1-6.

BACKGROUND

Prostate cancer (PC) is one of the leading causes of cancer death among men with the American Cancer Society's estimate of 31,620 deaths from prostate cancer for 2019. Chemotherapy and androgen deprivation therapy (ADT) represent the cornerstone treatments. However, these treatments are not specific and have broad off targeting effects at therapeutic dose (TD) leading to significant morbidities. Importantly, chemotherapy and ADT are ineffective against neuroendocrine prostate cancer (NEPC), a deadly PC subtype. In fact, ADT gives rise to treatment emergent NEPC, which rapidly metastasize and kill the patient. The medium survival benefit under current therapies is less than 5 months. The emergence of more potent ADT agents on the market will continue to increase NEPC incidences. In addition, the average cost for treatment over a patient's lifetime is estimated at ~$177,7041. In some cases, active surveillance and follow-up treatments over a period of years significantly increases treatment cost. There is a need for safer, durable, and cost competitive therapy alternatives.

Similar to NEPC, pancreatic cancer (PanC) incidence is on the rise. PanC is predicted to become the second most lethal cancer by 2030. This year alone, it is estimated that ~57,600 people will be diagnosed with PanC in the United States. PanC is largely asymptomatic in the early stages of the diseases. As such, only ~20% of patients are diagnosed early enough to qualify for curative surgery (pancreatectomy). Surgery is costly, causes significant morbidity, and substantially reduces quality of life for these patients. Further, over 75% of these patients will eventually relapse with local or distant tumors, suggesting that patients with seemingly local disease already have undetectable micrometastases, which underscores the inherent systemic nature of the disease. Patients presenting with distant metastatic disease, which accounts for over 70% of patients, are uncurable under the current standard of care. These patients are treated with chemotherapy (e.g. nab-paclitaxel, gemcitabine, FOLFIRINOX, and Irinotecan liposomes) that are considerably toxic and yet, lack durable survival benefit. Most patients quickly develop chemoresistance and die within a year of treatment initiation. There is an urgent clinical need for safe and potent therapeutics to achieve durable clinical benefits for patients.

Agents targeting immune checkpoint molecules (e.g. CTLA-4, PD-1/PDL-1, etc.) generate durable clinical benefits for cancer patients. However, these benefits have not been realized in prostate or pancreatic cancers due to the poor immunogenicity of these cancers.

Efforts to develop cancer-targeted therapeutics include the use of cancer-targeting bacteria to achieve cancer-specific cell killing. However, it has been a challenge to transition these bacteria-based approaches to the clinic due to a lack of a bacteria strain that is both safe and efficacious. Several bacterial strains have been developed, including the *Salmonella enterica* serovar *typhimurium* strain VNP20009, one of the most studied tumor-targeting strains. VNP20009 was first isolated in a genetic screen for hyperinvasion mutants using a library of mutant strains derived from ultraviolet and chemical mutagenesis of strain 14028. Additional targeted genetic mutations were previously introduced in the msb, lipid A, and purl loci to attenuate VNP20009 and generate purine auxotrophy, respectively. The safety and efficacy of VNP20009 were demonstrated in a wide range of preclinical animal cancer models, ultimately leading to clinical trials on metastatic melanoma or renal cell carcinoma patients. VNP20009 showed moderate toxicity but no antitumor effect in the aforementioned clinical studies, presumably because it was rapidly cleared by patients' immune system. These studies have provided significant clinical insights and have underscored the need for cancer-targeting biologics that are not only safe and efficacious, but also likely to translate to the clinic.

SUMMARY

This disclosure is directed to compositions, pharmaceutical compositions, and methods for treating certain conditions using a composition. The composition comprises a biologically pure isolate of the genus *Salmonella* comprising archival strain CRC1674, wherein the isolate further comprises a disruption of at least one gene selected from the group consisting of aroA, rfaH, and thyA and at least one of a chemotherapy agent, an immunotherapy agent, and an androgen receptor antagonist.

Further, the disclosure is directed to a composition comprising an archival *Salmonella enterica* serovar *Typhimurium* strain CRC2631 and at least one of a chemotherapy agent, an immunotherapy agent, and an androgen receptor antagonist.

Additionally, the disclosure describes a pharmaceutical composition comprising the compositions described herein and one or more pharmaceutically acceptable carriers or excipients.

The disclosure further describes methods for treating cancer in a patient in need thereof. Cancers can include solid tumors such as pancreatic cancer. The method comprises administering an effective amount of a biologically pure isolate of the genus *Salmonella* comprising archival strain CRC1674, wherein the isolate further comprises a disruption of at least one gene selected from the group consisting of aroA, rfaH, and thyA, and a chemotherapy agent, an immunotherapy agent, or a chemotherapy agent and an immunotherapy agent.

Also, the disclosure describes methods for treating prostate cancer in a patient in need thereof. The method comprises administering an effective amount of a biologically pure isolate of the genus *Salmonella* comprising archival strain CRC1674, wherein the isolate further comprises a disruption of at least one gene selected from the group consisting of aroA, rfaH, and thyA and a chemotherapy agent, an androgen receptor antagonist, or a chemotherapy agent and androgen receptor antagonist.

BRIEF DESCRIPTION OF THE DRAWINGS

The disclosure will be better understood, and features, aspects and advantages other than those set forth above will become apparent when consideration is given to the following detailed description thereof. Such detailed description makes reference to the following drawings, wherein:

FIG. 1A depicts an optical density conversion equation. Best fit curve equations (OD to viable cells/mL) were derived from CRC2631 independent clonal populations suspended in PBS at three different 600 nm optical densities (OD) after growth for 24 h in liquid culture and viable cells/mL determined by plating dilution series of each culture on plates containing appropriate selective antibiotics (see Example 1) and enumerated after 30 h incubation at 37° C.

FIG. 1B depicts an optical density conversion equation. Best fit curve equations (OD to viable cells/mL) were derived from VNP20009 independent clonal populations suspended in PBS at three different 600 nm optical densities (OD) after growth for 24 h in liquid culture and viable cells/mL determined by plating dilution series of each culture on plates containing appropriate selective antibiotics (see Example 1) and enumerated after 30 h incubation at 37° C.

FIG. 1C depicts an optical density conversion equation. Best fit curve equations (OD to viable cells/mL) were derived from CRC2631$^{iRFP720-cat}$ independent clonal populations suspended in PBS at three different 600 nm optical densities (OD) after growth for 24 h in liquid culture and viable cells/mL determined by plating dilution series of each culture on plates containing appropriate selective antibiotics (see Example 1) and enumerated after 30 h incubation at 37° C.

Figure 3A:
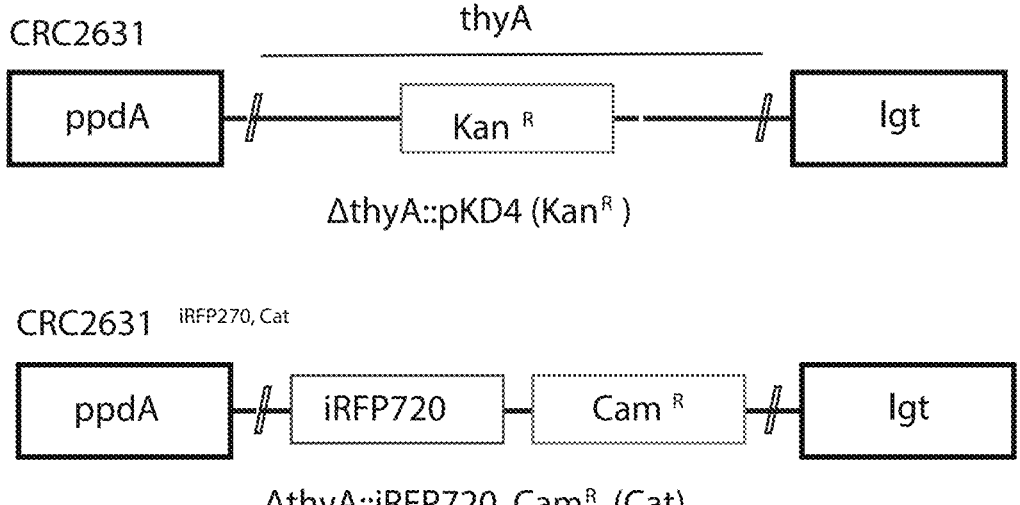
FIG. 3A depicts the re-engineering strategy used to create CRC2631$^{iRFP720-cat}$. The CRC2631 ΔthyA::Kan$^R$ region (top) was replaced with a gene that constitutively expresses iRFP720 and a chloramphenicol (Cam$^R$) (Cat) resistance cassette (bottom) for fluorescent detection in TRAMP models in vivo and selective recovery of CRC2631$^{iRFP720-cat}$ from tissue homogenates in biodistribution assays.
Figure 3B:
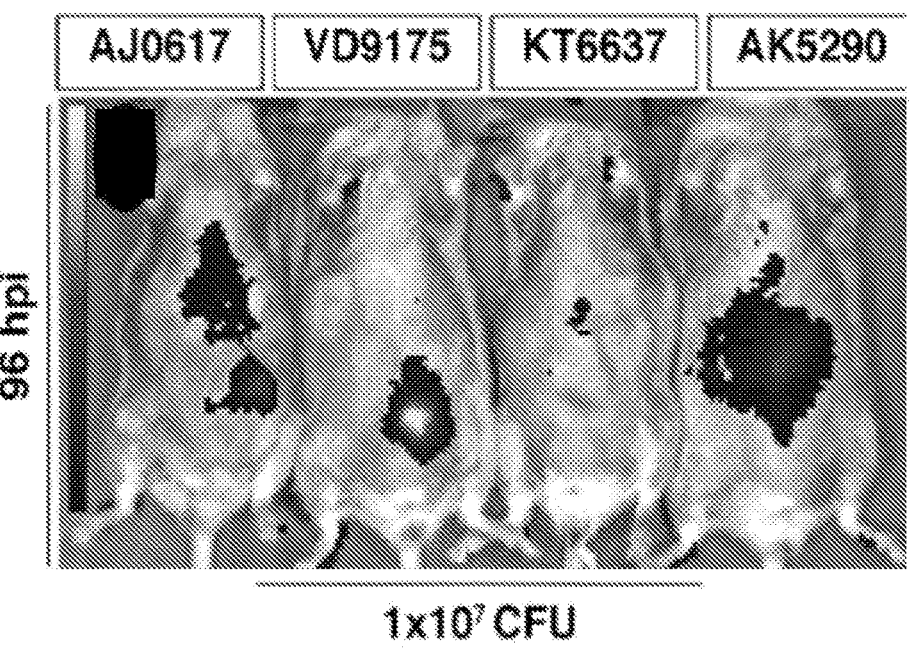
FIG. 3B depicts groups of three (N=3) male B6FVB TRAMP(+) mice (>25_weeks old) intravenously injected with single bolus doses of $1 \times 10^7$ CFU CRC2631$^{iRFP720-cat}$. In vivo fluorescence imaging of live B6FVB TRAMP(+) mice was performed 96 hours post injection to assess persistent tumor targeting capability of CRC2631$^{iRFP720-cat}$. Images were spectrally unmixed against negative controls (AK5290) to detect CRC2631$^{iRFP720-cat}$-associated iRFP720 signal. Dark areas indicate low CRC2631$^{iRFP720-cat}$-associated iRFP720 signal; light areas within dark areas indicate high CRC2631$^{iRFP720-cat}$-associated iRFP720 signal.
Figure 3C:
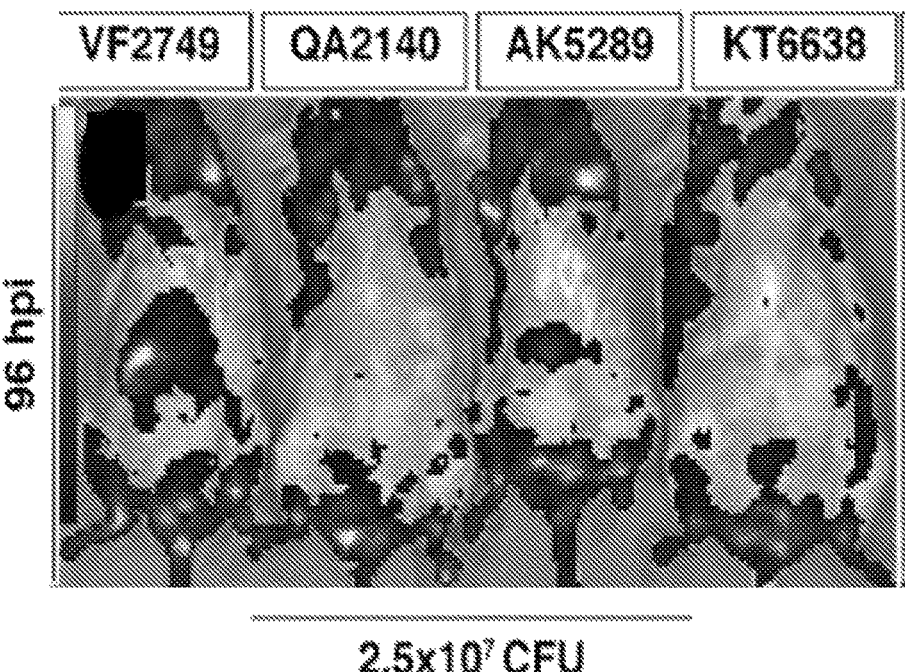
FIG. 3C depicts groups of three (N=3) male B6FVB TRAMP(+) mice (>25_weeks old) intravenously injected with single bolus doses of $2.5 \times 10^7$ CFU CRC2631$^{iRFP720-cat}$ to assay persistent targeting of primary and metastatic tumors at a higher dose. In vivo fluorescent scans of live B6FVB TRAMP(+) mice injected with CRC2631$^{iRFP720-cat}$ 96 hours post injection are shown. Images were spectrally unmixed against negative controls (KT6638) to detect CRC2631$^{iRFP720-cat}$-associated iRFP720 signal. Dark areas indicate low CRC2631$^{iRFP720-cat}$-associated iRFP720 signal; light areas within dark areas indicate high CRC2631$^{iRFP720-cat}$-associated iRFP720 signal.
Figures 3D, 3E:
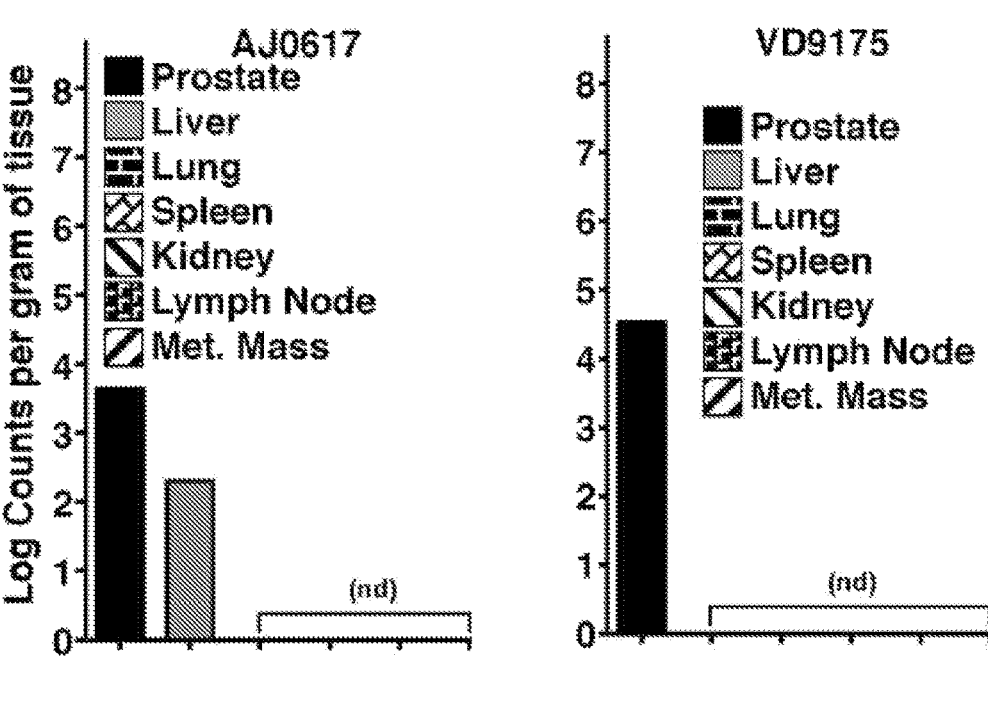
FIG. 3D depicts enumeration in AJ0617 of log CRC2631$^{iRFP720-cat}$ colony counts per gram of tissue at 190 hours post injection in the $1 \times 10^7$ CRC2631$^{iRFP720-cat}$ group. (nd) indicates tissues with no detectable CRC2631$^{iRFP720-cat}$/g tissue counts.

FIG. 3E depicts enumeration in VD9175 of log CRC2631$^{iRFP720-cat}$ colony counts per gram of tissue at 190 hours post injection in the $1 \times 10^7$ CRC2631$^{iRFP720-cat}$ group. (nd) indicates tissues with no detectable CRC2631$^{iRFP720-cat}$/g tissue counts.

Figure 3F:
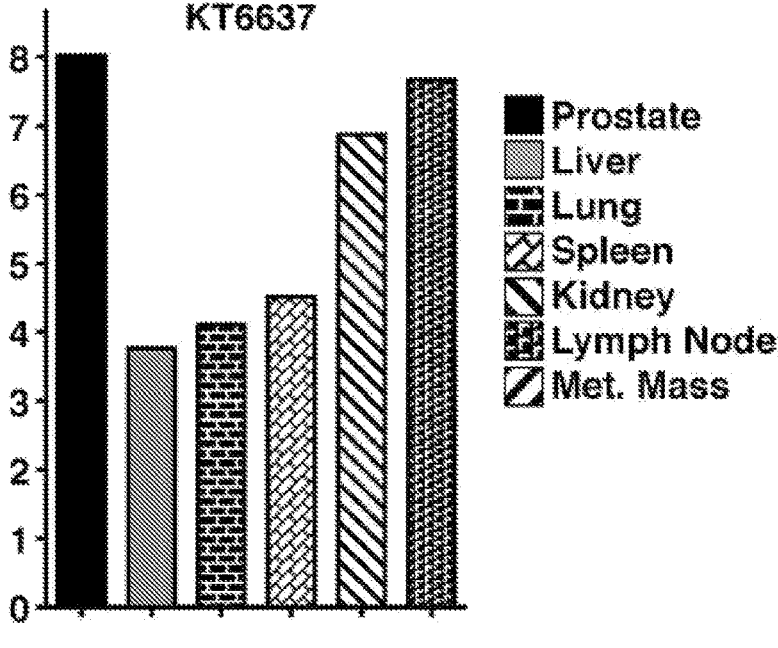

FIG. 3F depicts enumeration in KT6637 of log CRC2631$^{iRFP720-cat}$ colony counts per gram of tissue at 190 hours post injection in the $1 \times 10^7$ CRC2631$^{iRFP720-cat}$ group.

Figure 3G:
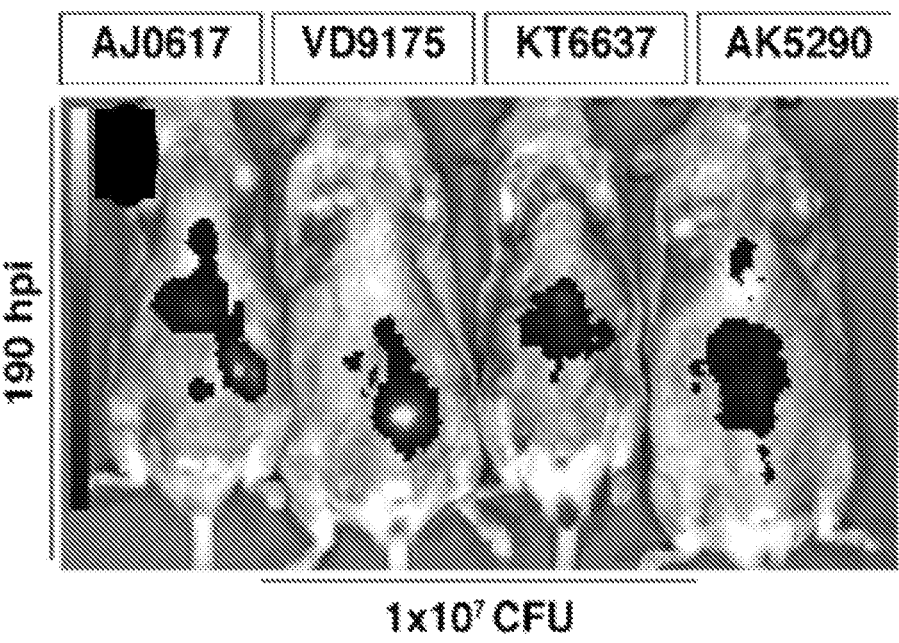

FIG. 3G depicts groups of three (N=3) male B6FVB TRAMP(+) mice (>25_weeks old) intravenously injected with single bolus doses of $1 \times 10^7$ CFU CRC2631$^{iRFP720-cat}$. In vivo fluorescence imaging of live B6FVB TRAMP(+) mice was performed 190 hours post injection to assess persistent tumor targeting capability of CRC2631$^{iRFP720-cat}$. Images were spectrally unmixed against negative controls (AK5290) to detect CRC2631$^{iRFP720-cat}$-associated iRFP720 signal. Dark areas indicate low CRC2631$^{iRFP720-cat}$-associated iRFP720 signal; light areas within dark areas indicate high CRC2631$^{iRFP720-cat}$-associated iRFP720 signal.

Figure 3H:
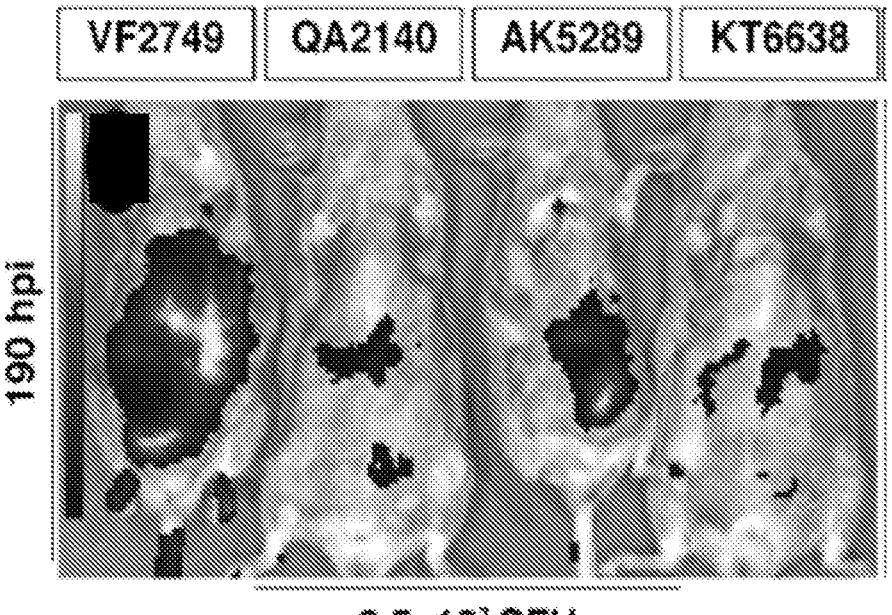

FIG. 3H depicts groups of three (N=3) male B6FVB TRAMP(+) mice (>25_weeks old) intravenously injected with single bolus doses of $2.5 \times 10^7$ CFU CRC2631$^{iRFP720-cat}$ to assay persistent targeting of primary and metastatic tumors at a higher dose. In vivo fluorescent scans of live B6FVB TRAMP(+) mice injected with CRC2631$^{iRFP720-cat}$ 190 hours post injection are shown. Images were spectrally unmixed against negative controls (KT6638) to detect CRC2631$^{iRFP720-cat}$-associated iRFP720 signal. Dark areas indicate low CRC2631$^{iRFP720-cat}$-associated iRFP720 signal; light areas within dark areas indicate high CRC2631$^{iRFP720-cat}$-associated iRFP720 signal.

Figure 3I:
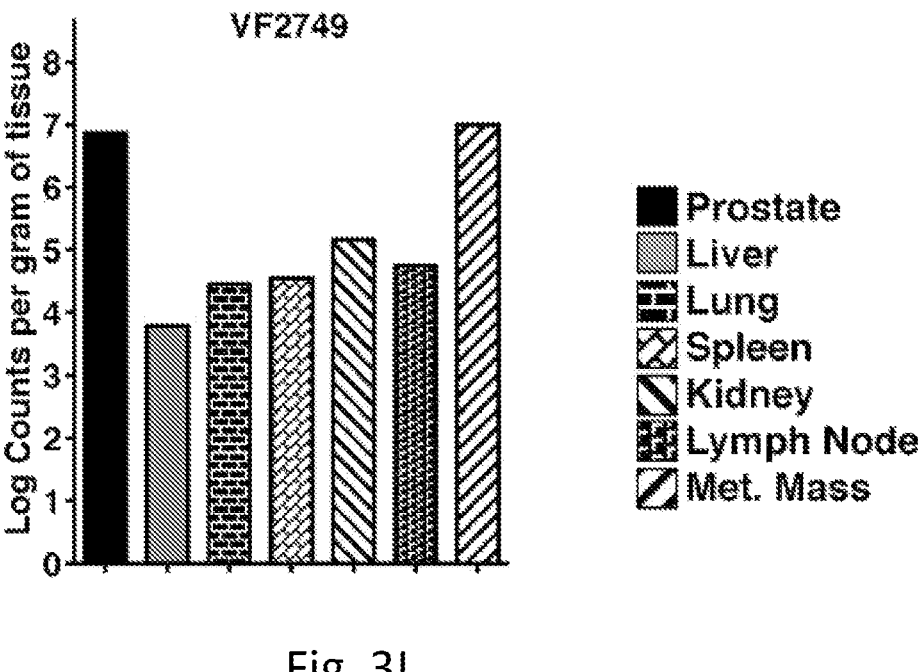

FIG. 3I depicts enumeration in VF2749 of log CRC2631$^{iRFP720-cat}$ colony counts per gram of tissue at 190 hours post injection in the $2.5 \times 10^7$ CRC2631$^{iRFP720-cat}$ group.

Figure 3J:
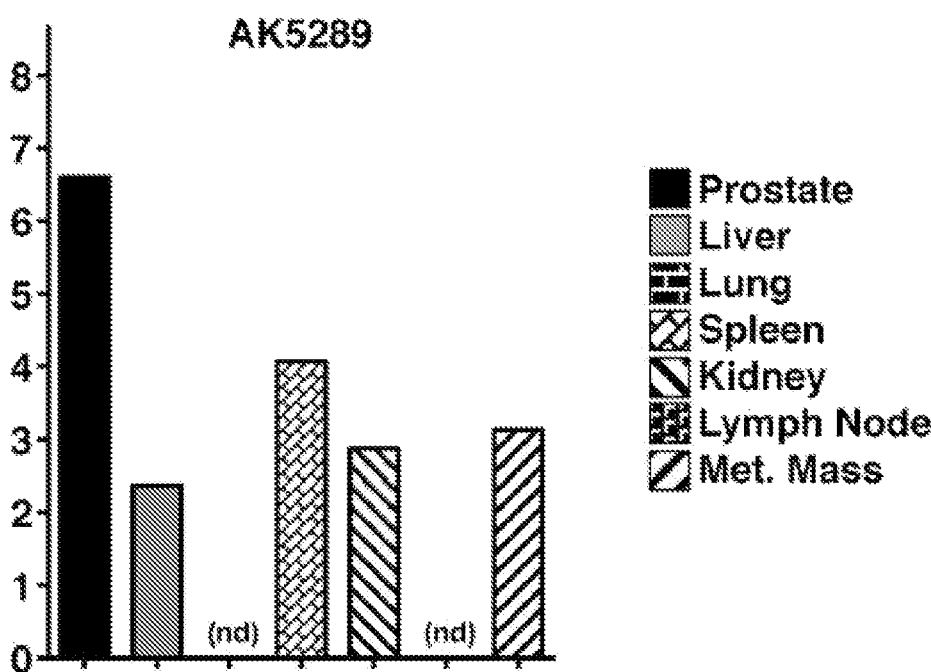

FIG. 3J depicts enumeration in AK5289 of log CRC2631$^{iRFP720-cat}$ colony counts per gram of tissue at 190 hours post injection in the $2.5 \times 10^7$ CRC2631$^{iRFP720-cat}$ group. (nd) indicates tissues with no detectable CRC2631$^{iRFP720-cat}$/g tissue counts.

Figures 3K, 3L, 3M, 3N, 3O, 3P, 3Q, 3R:
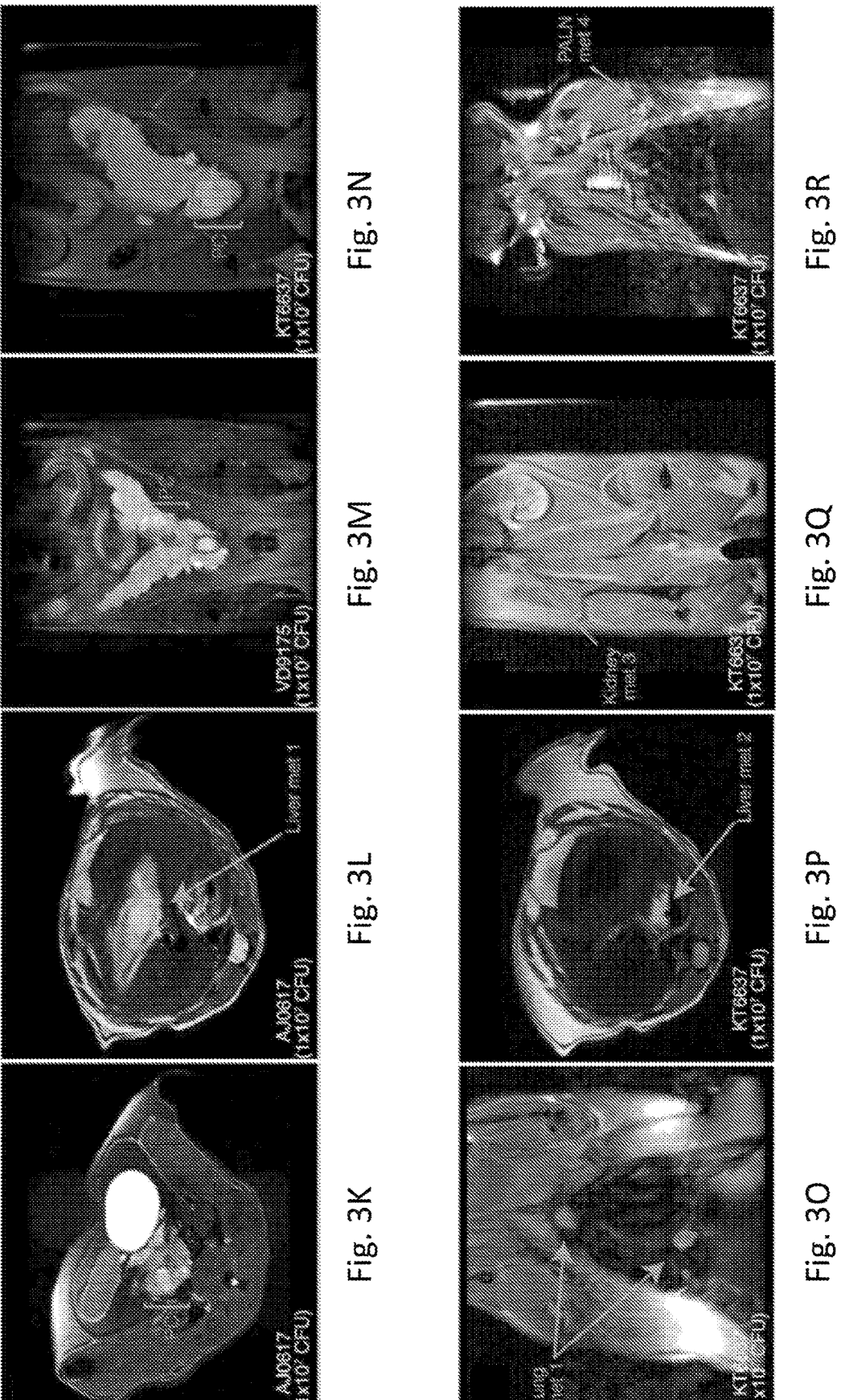

FIG. 3K depicts an MRI scan taken of AJ0617 to confirm primary prostate tumor (PC, brackets) in CRC2631$^{iRFP720-cat}$ colonized tissues identified by fluorescent scans and colony enumeration.

FIG. 3L depicts an MRI scan taken of AJ0617 to confirm metastatic (Met, regions indicated by arrows) tumor targeting tropism in CRC2631$^{iRFP720-cat}$ colonized liver tissue identified by fluorescent scans and colony enumeration.

FIG. 3M depicts an MRI scan taken of VD9175 to confirm primary prostate tumor (PC, brackets) in CRC2631$^{iRFP720-cat}$ colonized tissues identified by fluorescent scans and colony enumeration.

FIG. 3N depicts an MRI scan taken of KT6637 to confirm primary prostate tumor (PC, brackets) in CRC2631$^{iRFP720-cat}$ colonized tissues identified by fluorescent scans and colony enumeration.

FIG. 3O depicts an MRI scan taken of KT6637 to confirm metastatic (Met, regions indicated by arrows) tumor targeting tropism in CRC2631$^{iRFP720-cat}$ colonized lung tissue identified by fluorescent scans and colony enumeration.

FIG. 3P depicts an MRI scan taken of KT6637 to confirm metastatic (Met, regions indicated by arrows) tumor targeting tropism in CRC2631$^{iRFP720-cat}$ colonized liver tissue identified by fluorescent scans and colony enumeration.

FIG. 3Q depicts an MRI scan taken of KT6637 to confirm metastatic (Met, regions indicated by arrows) tumor targeting tropism in CRC2631$^{iRFP720-cat}$ colonized kidney tissue identified by fluorescent scans and colony enumeration.

FIG. 3R depicts an MRI scan taken of KT6637 to confirm metastatic (Met, regions indicated by arrows) tumor targeting tropism in CRC2631$^{iRFP720-cat}$ colonized PALN (proper axillary lymph node) tissue identified by fluorescent scans and colony enumeration.

Figures 3S, 3T, 3U, 3V:
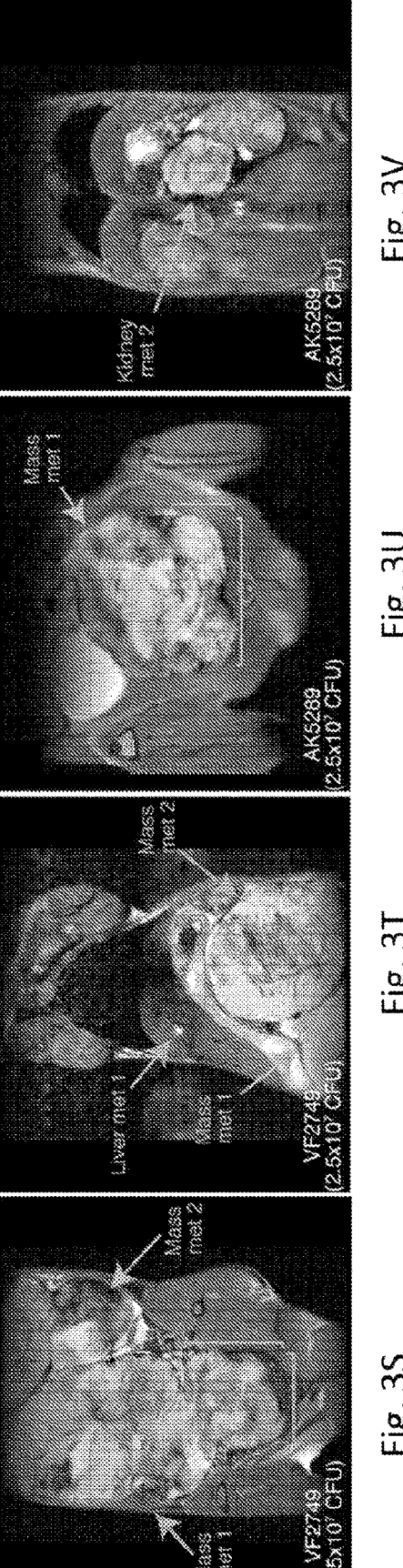

FIG. 3S depicts an MRI scan taken of VF2749 to confirm primary prostate tumor (brackets) and metastatic (Met, regions indicated by arrows) tumor targeting tropism in CRC2631$^{iRFP720-cat}$ colonized tissue identified by fluorescent scans and colony enumeration. Metastatic masses were attached to the right kidney in the upper peritoneal cavity.

FIG. 3T depicts an MRI scan taken of VF2749 to confirm metastatic (Met, regions indicated by arrows) tumor targeting tropism in CRC2631$^{iRFP720-cat}$ colonized tissue identified by fluorescent scans and colony enumeration. A liver metastasis is shown, and metastatic masses were attached to the right kidney in the upper peritoneal cavity.

FIG. 3U depicts an MRI scan taken of AK5289 to confirm primary prostate tumor (brackets) and metastatic (Met, regions indicated by arrows) tumor targeting tropism in CRC2631$^{iRFP720-cat}$ colonized tissue identified by fluorescent scans and colony enumeration. A metastatic mass was adjacent to the primary prostate tumor.

FIG. 3V depicts an MRI scan taken of AK5289 to confirm metastatic (Met, regions indicated by arrows) tumor targeting tropism in CRC2631$^{iRFP720-cat}$ colonized kidney tissue identified by fluorescent scans and colony enumeration.

Figure 4A:
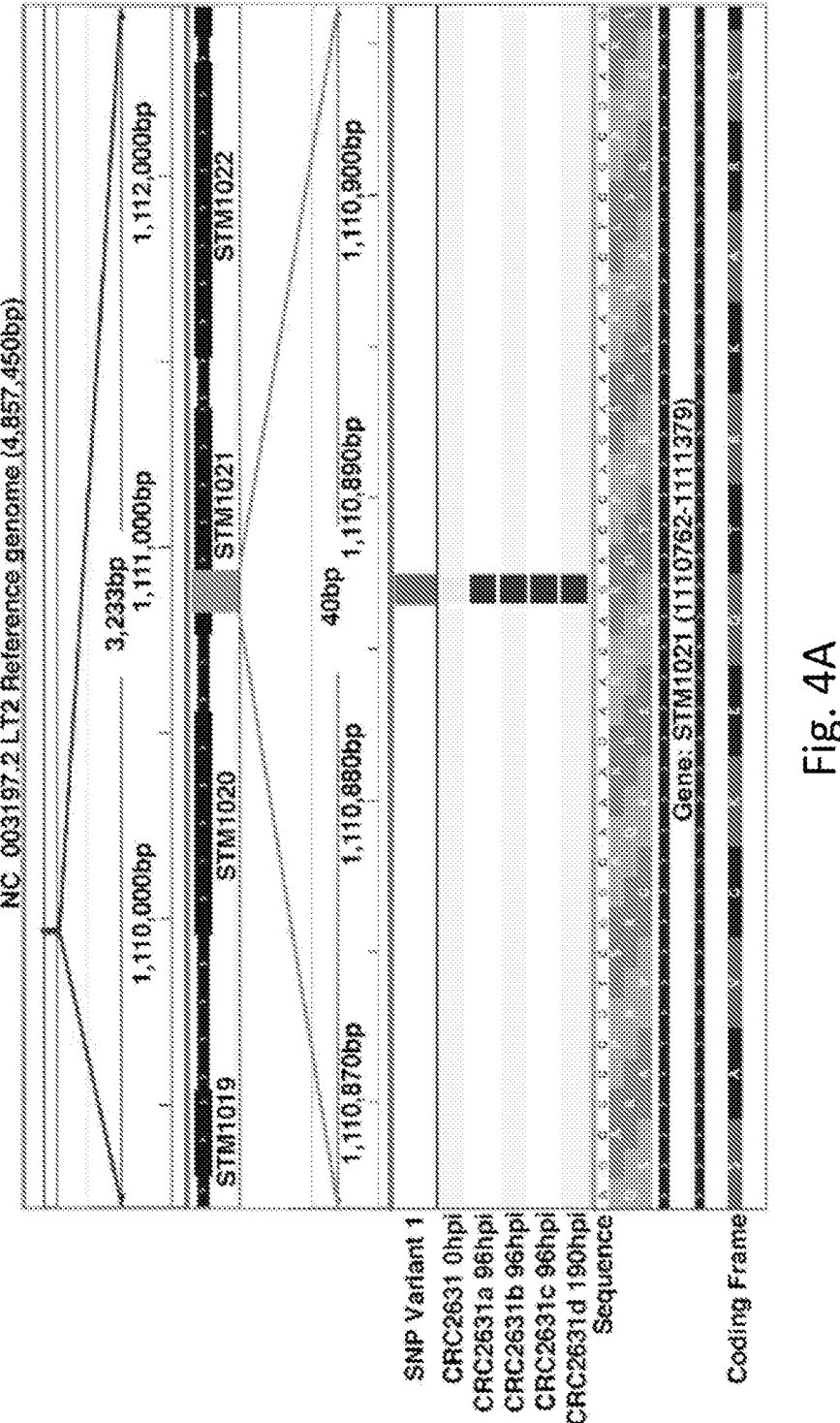

FIG. 4A depicts chromosomal DNA isolated from CRC2631 before injection and after passage through individual B6 TRAMP(+) mouse prostate tumor tissue samples at 96 hours post injection. Genomic DNA libraries were produced for all samples and sequenced using NovaSeq® 2×100 lane kit protocols (Illumina®). Graphical representations of single-nucleotide polymorphism (SNP) variant 1 using Integrative Genomics Viewer (v2.8.0). SNP locations are shown at three genomic resolutions; from top to bottom, the SNP location is indicated as a box at the cytologic overview, followed by increase in the genomic resolution to the local gene region showing labeled gene coding regions and the SNP location as a larger box, and finally followed by showing the SNP location as a box at nucleotide resolution as SNP Variant 1. Below, the SNP location is in light grey if no change was made from the CRC2631 parent, and the SNP location is in black if there was a SNP mutation from the CRC2631 parent.

Figure 4B:
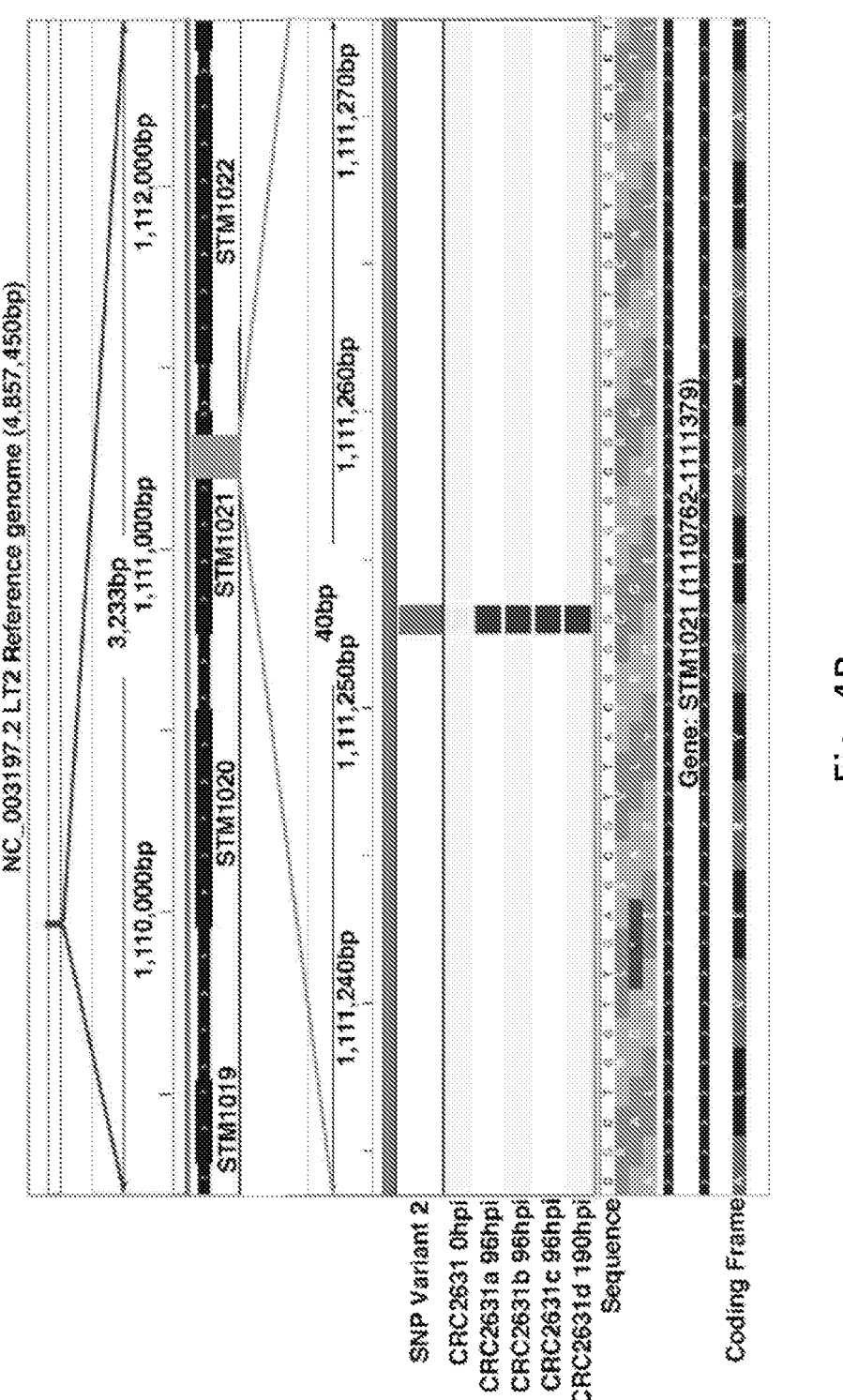

FIG. 4B depicts chromosomal DNA isolated from CRC2631 before injection and after passage through individual B6 TRAMP(+) mouse prostate tumor tissue samples at 96 hours post injection. Genomic DNA libraries were produced for all samples and sequenced using NovaSeq® 2×100 lane kit protocols (Illumina®). Graphical representations of SNP variant 2 using Integrative Genomics Viewer (v2.8.0). SNP locations are shown at three genomic resolutions; from top to bottom, the SNP location is indicated as a box at the cytologic overview, followed by increase in the genomic resolution to the local gene region showing labeled gene coding regions in and the SNP location as a larger box, and finally followed by showing the SNP location as a box at nucleotide resolution as SNP Variant 2. Below, the SNP location is in light grey if no change was made from the CRC2631 parent, and the SNP location is in black if there was a SNP mutation from the CRC2631 parent.

Figure 4C:
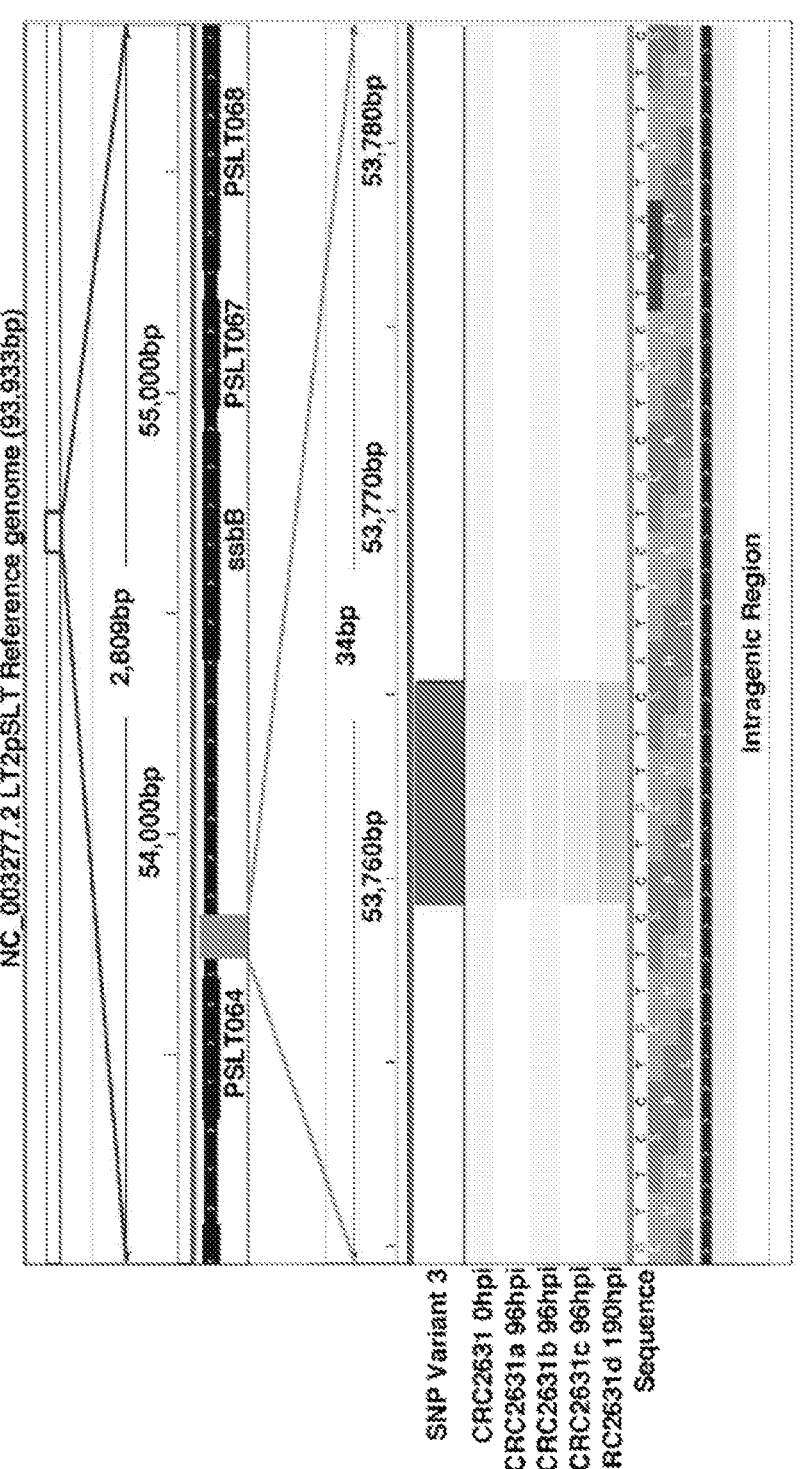

FIG. 4C depicts chromosomal DNA isolated from CRC2631 before injection and after passage through individual B6 TRAMP(+) mouse prostate tumor tissue samples at 190 hours post injection. Genomic DNA libraries were produced for all samples and sequenced using NovaSeq® 2×100 lane kit protocols (Illumina®). Graphical representations of SNP variant 3 using Integrative Genomics Viewer (v2.8.0). SNP locations are shown at three genomic resolutions; from top to bottom, the SNP location is indicated as a box at the cytologic overview, followed by increase in the genomic resolution to the local gene region showing labeled gene coding regions in and the SNP location as a larger box, and finally followed by showing the SNP location as a large rectangle at nucleotide resolution as SNP Variant 3. Below, the SNP location is in light grey if no change was made from the CRC2631 parent, and the lowest SNP location in dark grey indicates a deletion of 6 bp repeat in CRC2631 that reverts CRC2631d to original LT2 sequence.

Figure 4D:
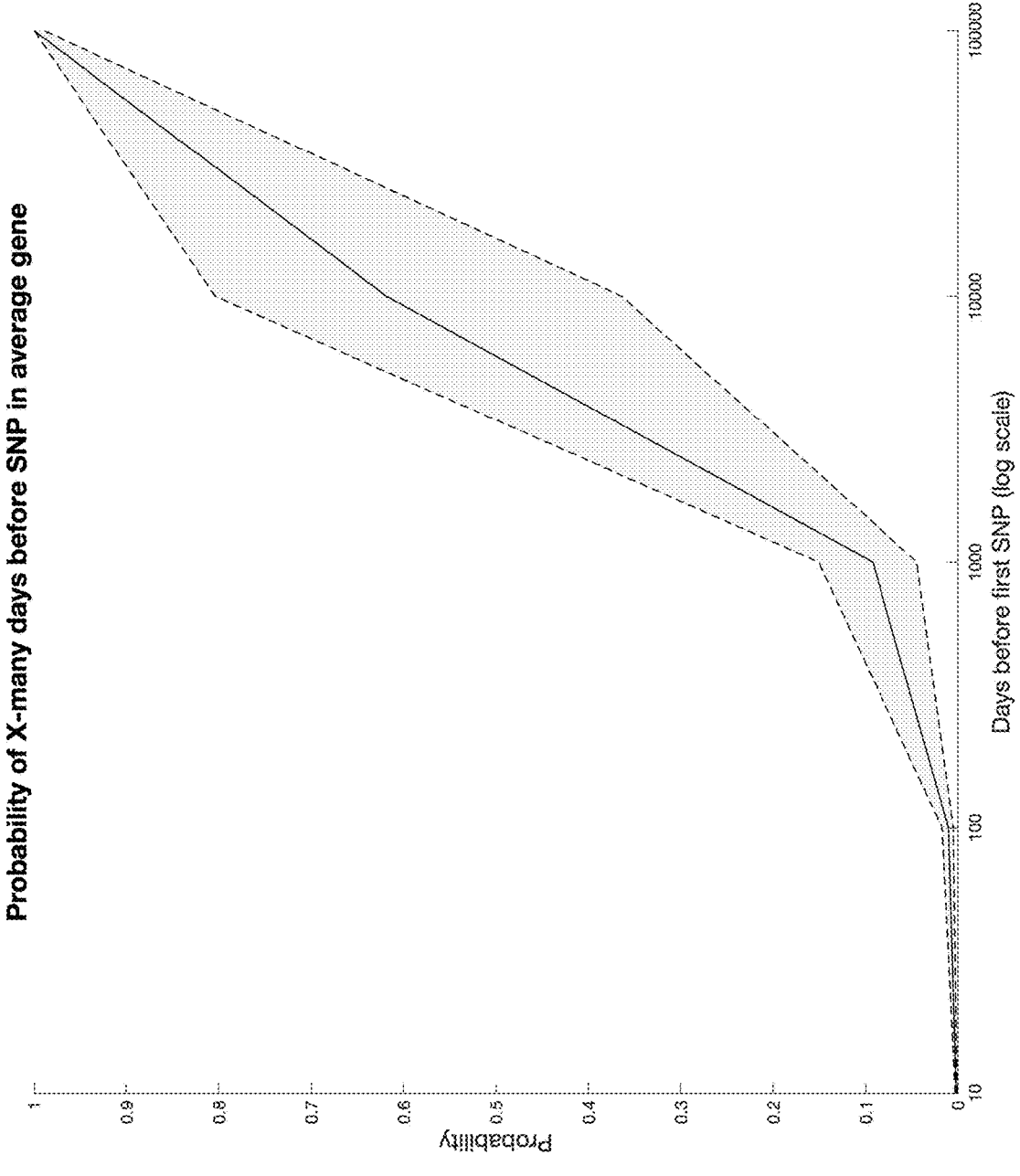

FIG. 4D depicts SNP prediction modeling that displays, on a logarithmic scale, the probability of an average gene in CRC2631 accumulating a first SNP after a given number of days in the tumor environment. These models predict that the risk of an average gene accumulating a first SNP after 10, 100, 1000, 10000 and 100000 days to be: 0.0015, 0.01, 0.0921, 0.6181, and 0.9999 respectively.

Figure 5A:
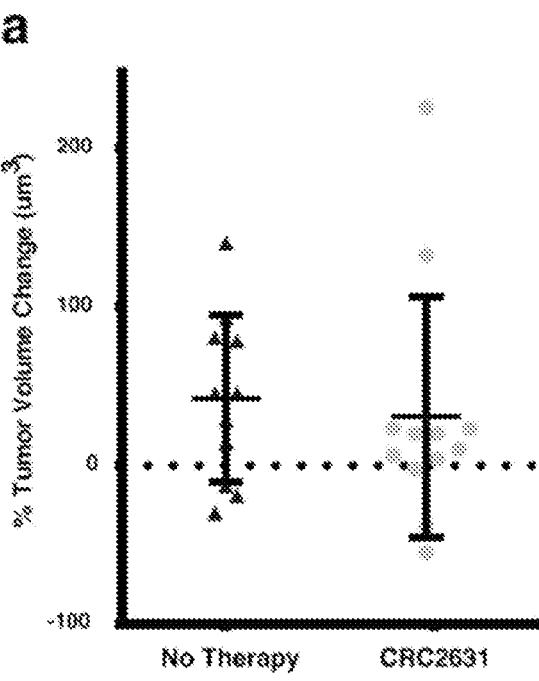

FIG. 5A depicts percentage change of ventral prostate tumor volume in 8-10-week-old B6FVB TRAMP(+) (N=12) male mice measured using MRI 5-7 days before and 21 days after starting four intravenous (IV) tail injections at three day intervals of 200 ul PBS (No therapy, left) or 2.5×10$^7$ CRC2631 (right).

Figure 5B:
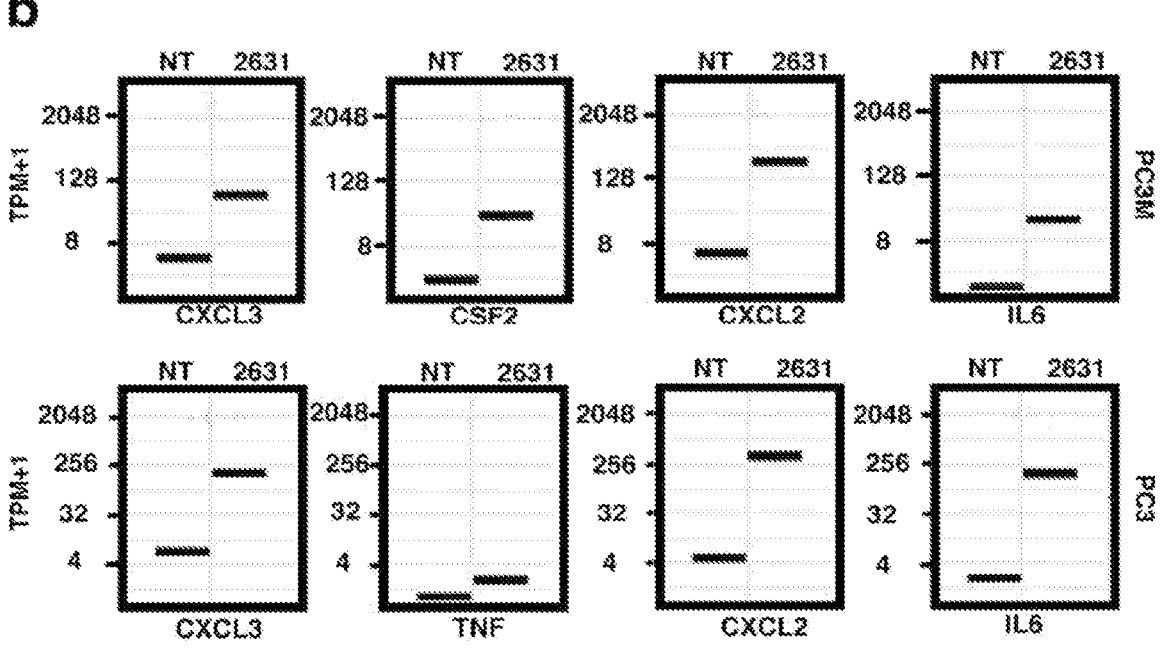

FIG. 5B depicts a box plot showing the expression of immune cytokines and chemokines in PC3M and PC3 human prostate cancer cell lines in response to CRC2631 treatment (N=3). TPM indicates gene transcripts per million. NT indicates No Treatment. 2631 indicates CRC2631 treated cells.

Figure 5C:
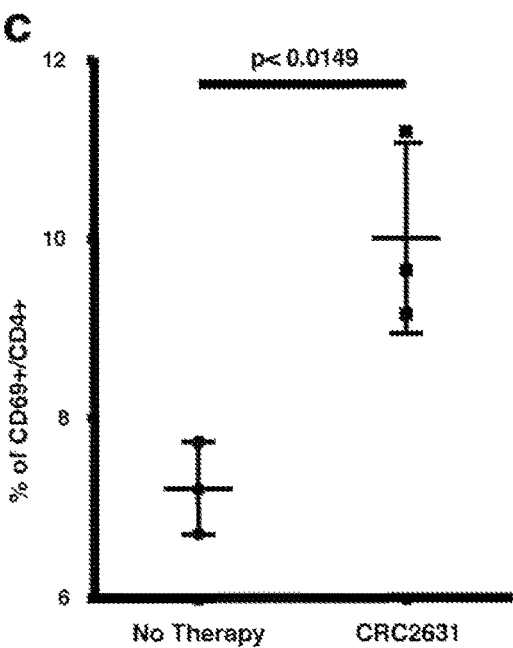

FIG. 5C depicts flow cytometric TILs profiling of metastasized lymph nodes extracted from PBS (no therapy) or CRC2631-treated B6FVB TRAMP(+) model group (N=3) to identify change in % of CD69+/CD4+fraction of cell population between no therapy and CRC2631-treated group. Student's t test analyses measured significance.

Figure 5D:
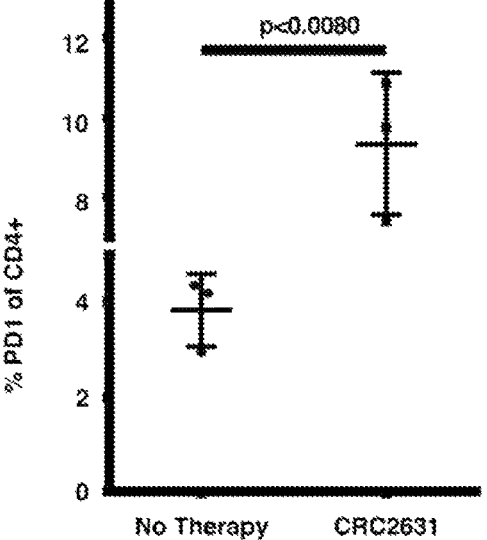

FIG. 5D depicts flow cytometric TILs profiling of metastasized lymph nodes extracted from PBS (no therapy) or CRC2631-treated B6FVB TRAMP(+) model group (N=3) to identify % PD1 expressing cells of CD4+ cell population. Student's t test analyses measured significance.

Figure 5E:
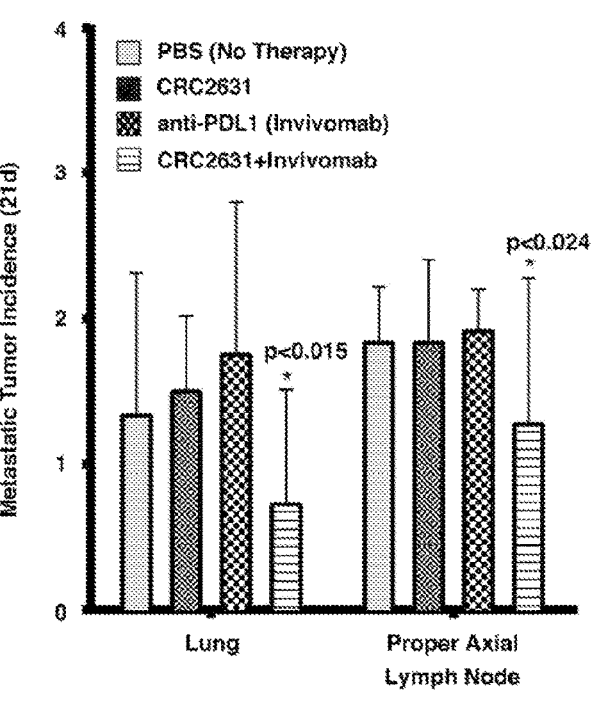

FIG. 5E depicts a comparison of metastasis incidence in lymph nodes and lung across treatment groups. Groups (N=12) of male B6FVB TRAMP(+) mice (8-10 weeks old) were IV injected with either PBS, 2.5×10$^7$ CRC2631, 0.5 mg of anti-mouse PDL1 antibody (Invivomab®), or CRC2631 and Invivomab® combination every three days for a total of four infusions. Post-treatment lung and proper axial lymph node MRI images taken 21 days after start of therapy were used to count and compare metastasis incidence across groups which were compared against PBS (control) and to determine significance using Student's t test.

Figure 5F:
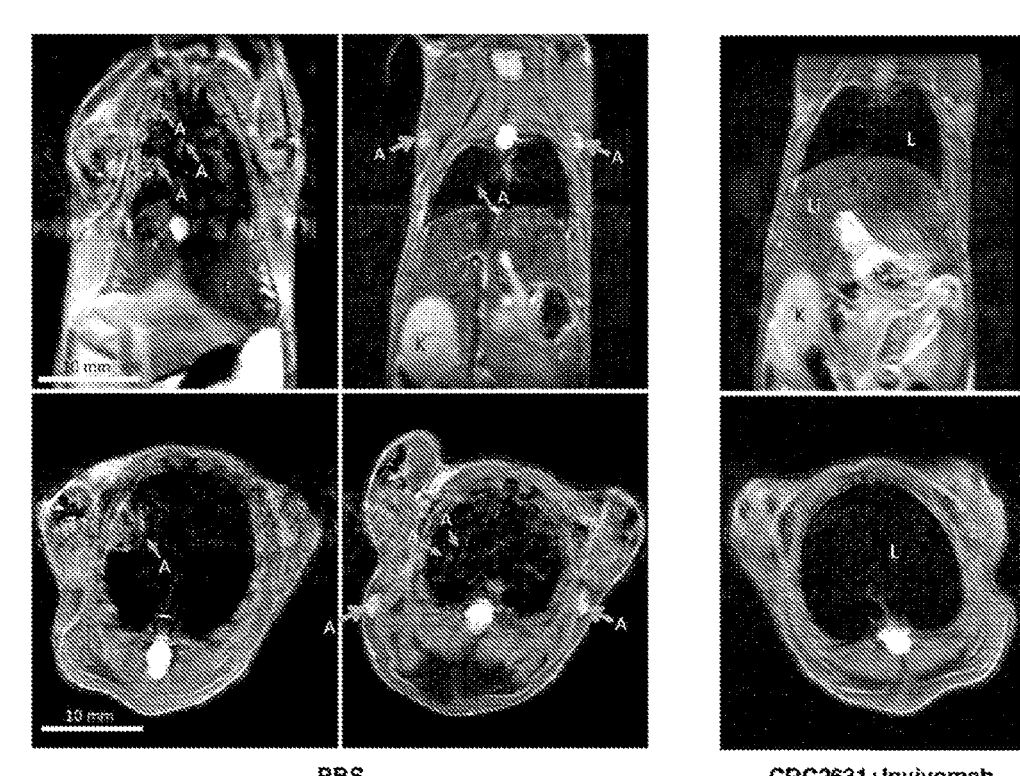

FIG. 5F depicts a comparison of metastasis incidence in lymph nodes and lung across treatment groups. Representative in vivo MRI images of TRAMP mouse model treated with PBS (control) or CRC2631 and Invivomab® combination. Control group showed more extensive lung tumors and proper axial lymph node metastases. The CRC2631-

Invivomab® combination therapy decreased the incidence of lung tumors and proper axial lymph node metastases. "A" indicates lung or lymph node metastasis. "L" indicates lungs, "Li" indicates liver, and "K" indicates kidney.

Figure 6:
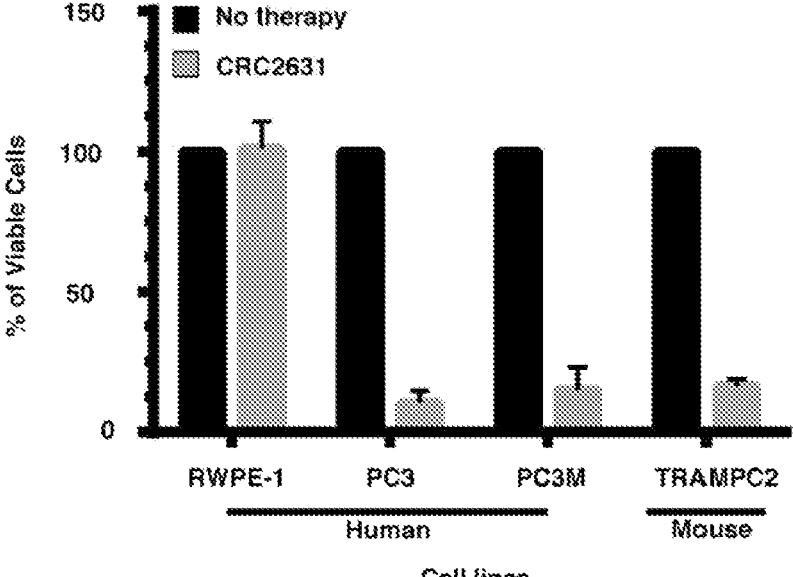

FIG. 6 depicts how CRC2631 specifically targets human and mouse prostate cancer cells. Human benign prostate (RWPE-1), prostate cancer and murine cancer cells ($10^4$) were treated with $10^4$ CFU of CRC2631 for 4 h at 37° C. and then washed. Cell viability was assessed using an MTT assay. Results represent the mean±SD of three trials performed in triplicates.

Figure 7A:
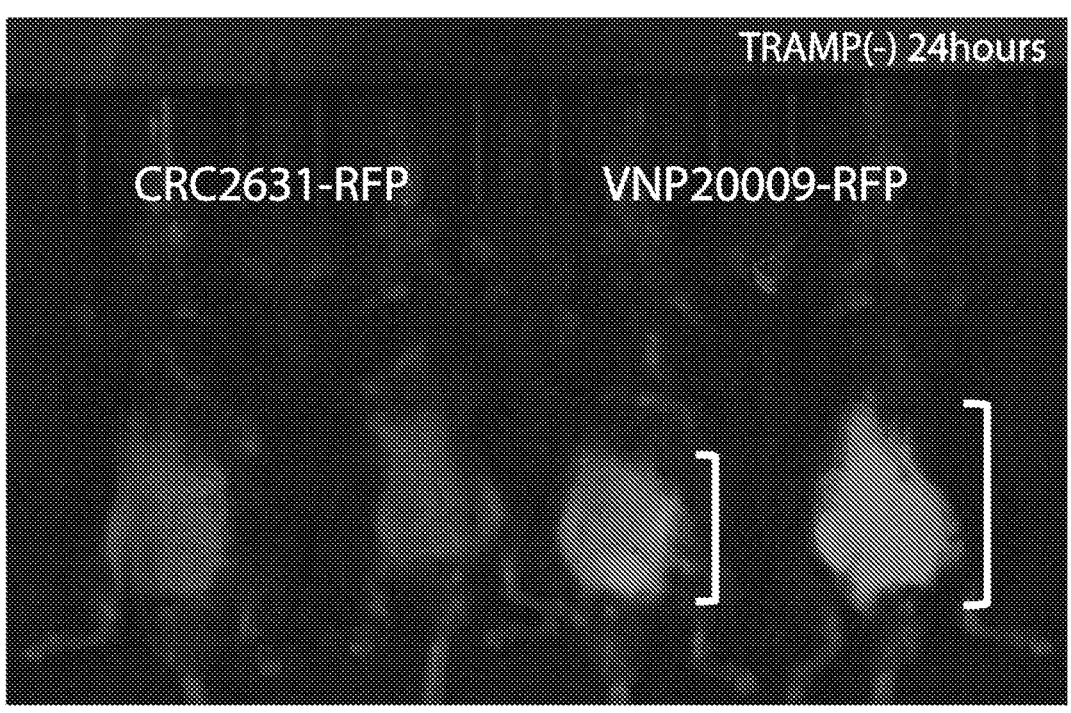

FIG. 7A depicts qualitative localization and persistence of CRC2631 and VNP20009 expressing mCherry red fluorescent protein (RFP) in B6 TRAMP(–) mice without primary prostate tumors. $1×10^6$ of each strain was administered interperitoneally and in vivo fluorescence scanning to detect mCherry RFP was performed at 24 hours post injection (hpi). Staining shows CRC2631- or VNP20009-associated unmixed mCherry signal (bracketed) or tissue autofluorescence. In contrast to the unspecific VNP20009 mCherry signal spread throughout the mouse abdomen, CRC2631 mCherry does not persist after 24 hours in B6 TRAMP(–) mice without primary prostate tumors.

Figure 7B:
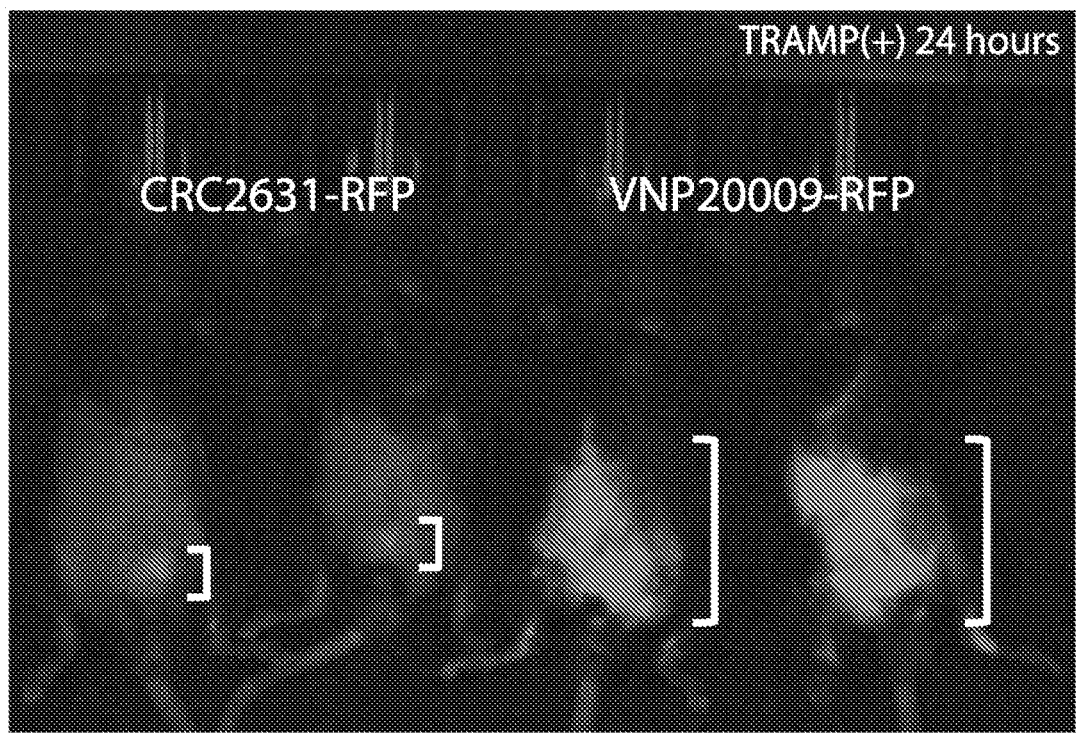

FIG. 7B depicts qualitative localization and persistence of CRC2631 and VNP20009 expressing mCherry red fluorescent protein (RFP) in B6 TRAMP(+) mice bearing primary prostate tumors. $1×10^6$ of each strain was administered interperitoneally and in vivo fluorescence scanning to detect mCherry RFP was performed at 24 hours post injection (hpi). Staining shows CRC2631- or VNP20009-associated unmixed mCherry signal (bracketed) or tissue autofluorescence. In contrast to the VNP20009 mCherry signal spread throughout the mouse abdomen, the CRC2631 mCherry signal is concentrated at the prostate. CRC2631 successfully colonizes the primary prostate tumor at 24 hpi in B6 TRAMP(+) mice.

Figure 7C:
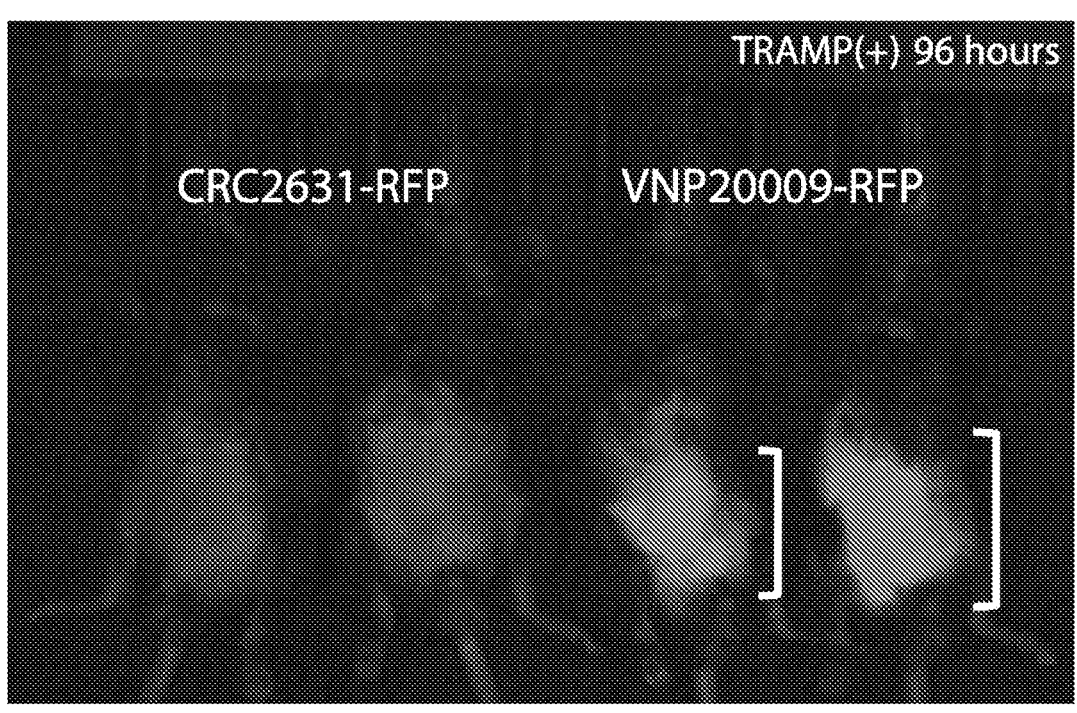

FIG. 7C depicts qualitative localization and persistence of CRC2631 and VNP20009 expressing mCherry red fluorescent protein (RFP) in B6 TRAMP(+) mice bearing primary prostate tumors. $1×10^6$ of each strain was administered interperitoneally and in vivo fluorescence scanning to detect mCherry RFP was performed at 96 hours post injection (hpi). Staining shows CRC2631- or VNP20009-associated unmixed mCherry signal (bracketed) or tissue autofluorescence. At 96 hpi, VNP20009 mCherry signal is spread throughout the mouse abdomen. CRC2631 mCherry signal becomes undetectable at 96 hpi.

Figure 7D:
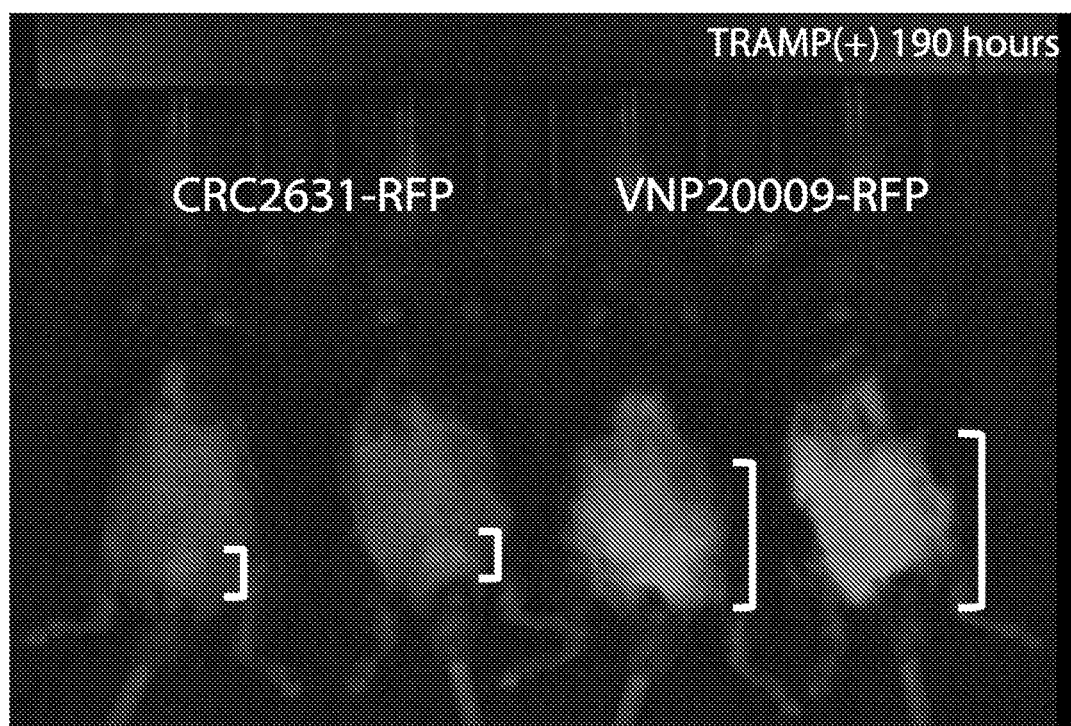

FIG. 7D depicts qualitative localization and persistence of CRC2631 and VNP20009 expressing mCherry red fluorescent protein (RFP) in B6 TRAMP(+) mice bearing primary prostate tumors. $1×10^6$ of each strain was administered interperitoneally and in vivo fluorescence scanning to detect mCherry RFP was performed at 190 hours post injection (hpi). Staining shows CRC2631- or VNP20009-associated unmixed mCherry signal (bracketed) or tissue autofluorescence. At 190 hpi, VNP20009 mCherry signal is spread throughout the mouse abdomen. CRC2631 mCherry signal re-emerges in the prostate tissue area at 190 hpi (brackets), demonstrating persistence in the B6 TRAMP(+) primary prostate tumor model.

Figure 8:
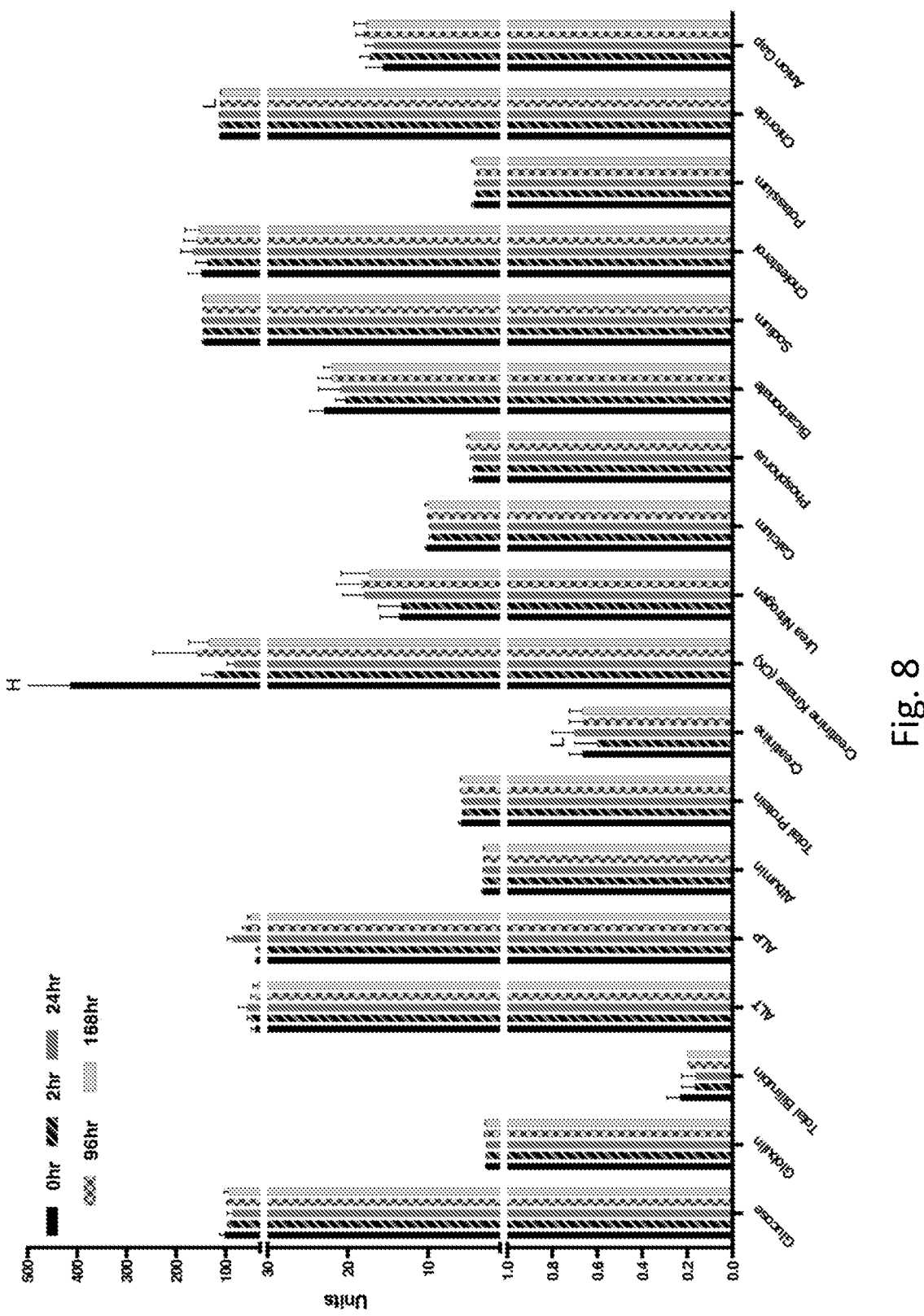

FIG. 8 depicts a toxicological assessment of CRC2631 in canine models. Three 13-month-old male beagles were administered $4×10^6$ CRC2631 intravenously, and plasma samples were collected at 0, 2, 24, 96, and 168 h time points. All animals tolerated CRC2631 injections. The chart shows the mean levels of plasma chemistry components in the three dogs to identify significant pathologies in organ tissue or metabolic function. All panels that included mean results outside of calibrated normal ranges (L=Low, H=High) are shown. Mean levels of creatinine below normal range at two hours post CRC2631 injection were not significantly different from initial levels (p<0.374). One dog exhibited high levels of creatinine kinase (CK) before injection of CRC2631, but CK levels were within normal range from 2-168 hours post injection and mean CK level changes from pre-injection to post injection were not significantly different at 2 h (p<0.372), 24 h (p<0.316), 96 h (p<0.436), or 168 h (p<0.389). Mean chloride levels at 96 hpi were below normal range but this was not significantly different from initial chloride levels (p<0.230). Each category on the x-axis shows from left to right columns for 0 hr, 2 hr, 24 hr, 96 hr, and 168 hr. Chemistry panels indicate no significant pathologies in organ tissue or metabolic function as a result of intravenous CRC2631 injections into dogs.

Figure 9A:
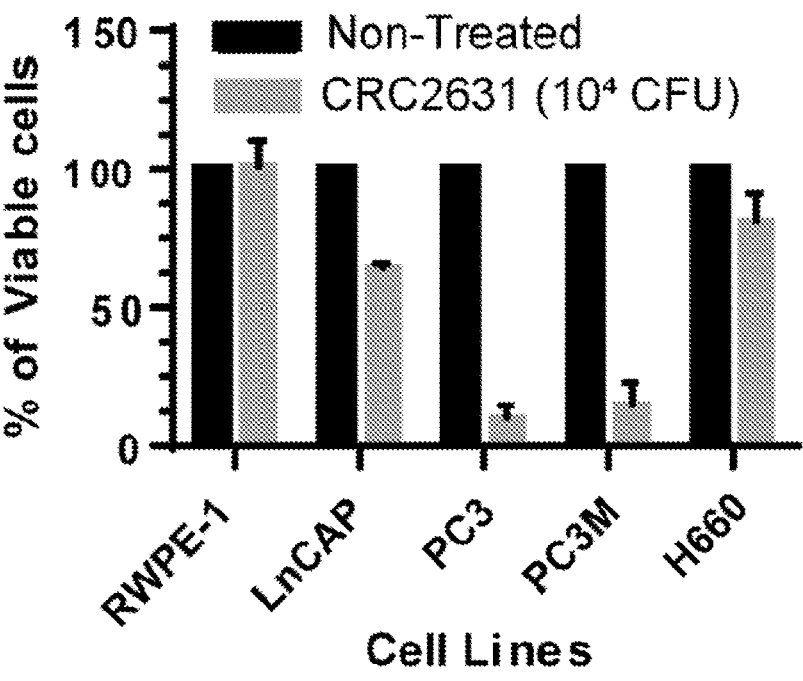

FIG. 9A depicts specificity of CRC2631 towards prostate cancer cells. Human benign prostate (RWPE-1) and prostate cancer (LnCAP, PC3, PC3M, H660) ($10^4$) cells were treated with $10^4$ CFU of CRC2631 for 4 h. Cell were then washed and cell viability was assessed using MTT assay. Results represent the mean±SD of three trials performed in triplicates.

Figure 9B:
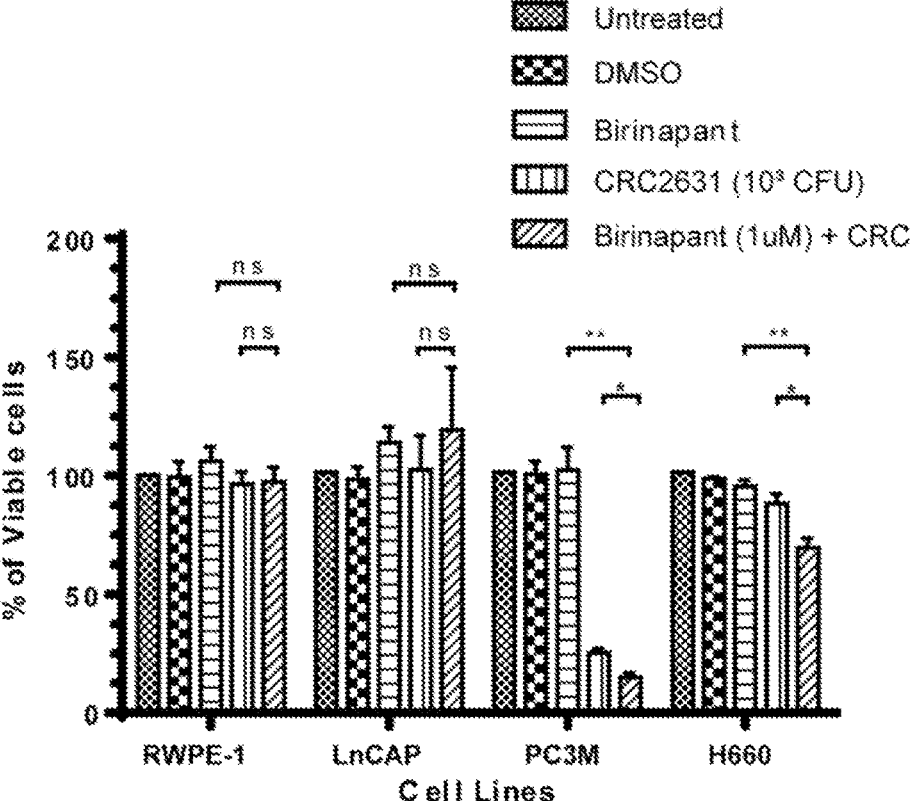

FIG. 9B depicts how CRC2631 in combination with birinapant kills prostate cancer and NEPC cells better than either treatment individually. Benign prostate (RWPE-1), prostate cancer (LnCAP, PC3M) and NEPC (H660) cells were treated with CRC2631 ($10^3$ CFU) and IAP antagonist, Birinapant (1 μM) either alone or in combination for 5 h. After washes, cell viability was measured by MTT assay. Results represent the mean±SD of three trials performed in triplicate (*, p<0.05; **, p<0.005, ns=not significant; Student's t-test).

Figure 9C:
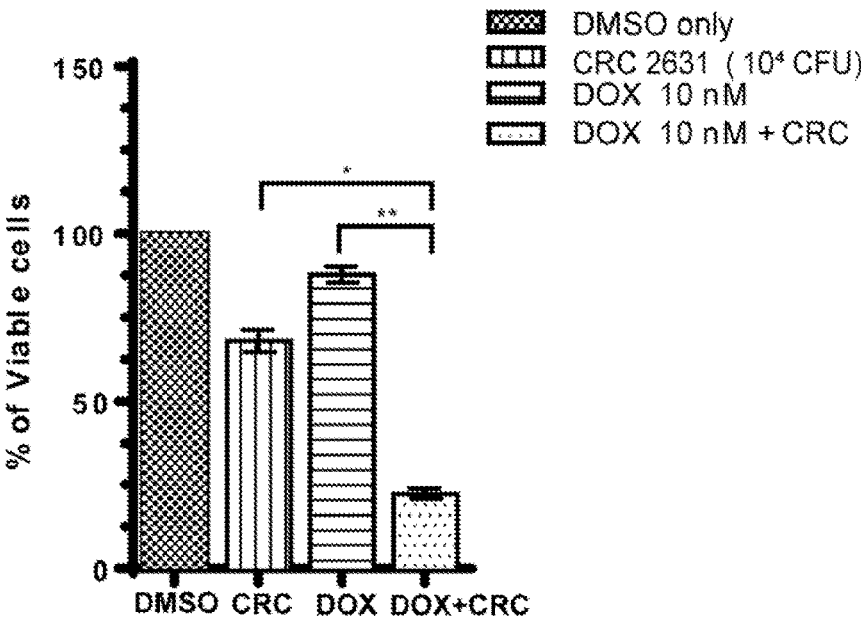

FIG. 9C depicts how CRC2631 in combination with standard chemotherapy treatment kills NEPC cells better than either individual treatment. NEPC (H660) cells ($10^3$) were treated with 10 nM of docetaxel (DOX) for 72 h. Media was replaced with fresh media containing CRC2631 ($10^4$ CFU) and cells were treated for 5 h. Cells were then washed and cell viability was measured using MTT assay. Results represent the mean±SD of three trials performed in triplicate (*, p<0.05; **, p<0.005; Student's t-test).

Figure 9D:
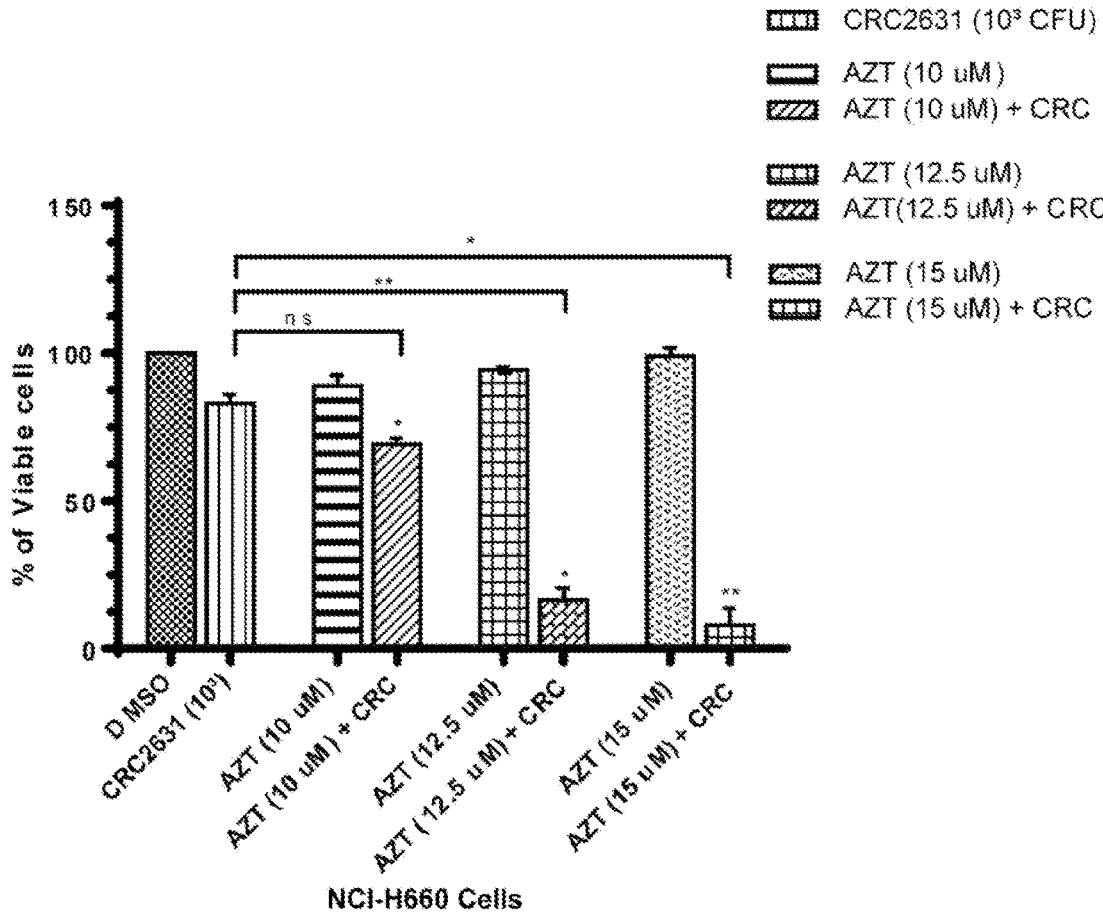

FIG. 9D depicts how CRC2631 in combination with standard androgen deprivation therapy kills NEPC cells better than either individual treatment. NEPC (H660) cells ($10^3$) were treated with 10 μM, 12.5 uM, or 15 uM enzalutamide (AZT) for 72 h. Media was replaced with fresh media containing CRC2631 ($10^3$ CFU) and cells were treated for 5 h. Cells were then washed and cell viability was measured using MTT assay. Results represent the mean±SD of three trials performed in triplicate (*, p<0.005; **, p<0.0005; Student's t-test)].

Figure 10A:
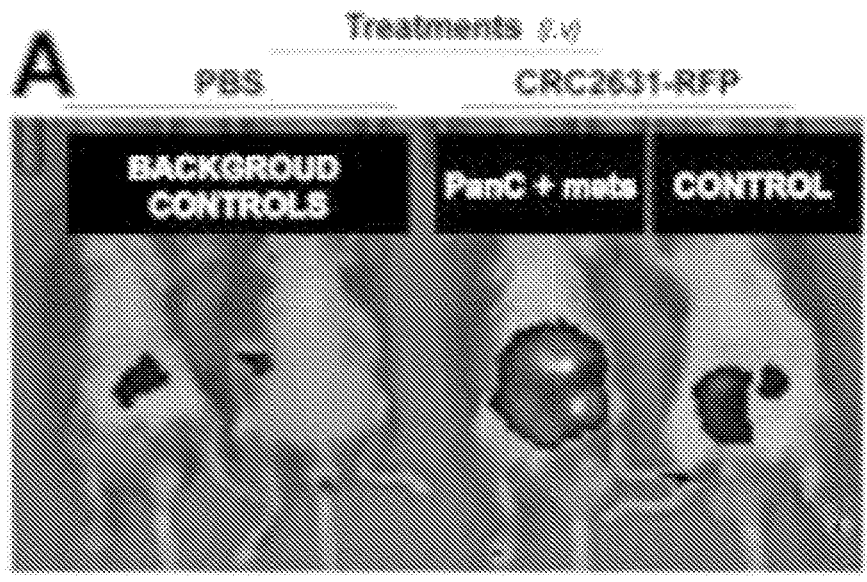

FIG. 10A depicts the tumor targeting capability of CRC2631$^{iRFP720-Cat}$ against pancreatic cancer in a mouse xenograft model. Groups (N=15) of tumor free (BL6) animals or animals carrying metastatic pancreatic cancer (B6Panc02H7) were treated intravenously with saline control (PBS) or iRFP-labeled CRC2631. In vivo fluorescence imaging was performed 4 days following treatment to assess the CRC2631 biodistribution. Dark areas indicate low CRC2631$^{iRFP720-cat}$-associated iRFP720 signal. Light areas within dark areas indicate high CRC2631$^{iRFP720-cat}$-associated iRFP720 signal, indicative of high CRC2631 load.

Figure 10B:
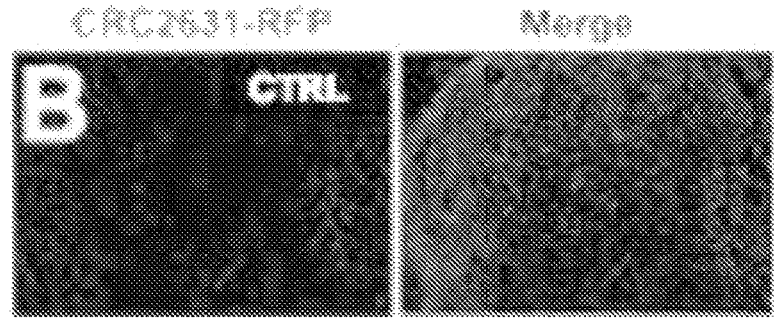

FIG. 10B depicts CRC2631$^{iRFP720-cat}$ imaging in pancreatic cryosectioned tissue sections obtained from tumor-free controls. CRC2631$^{iRFP720-cat}$ fluorescence is shown in the left panel, and this fluorescence is shown in a merge with DNA staining in the right panel.

Figure 10C:
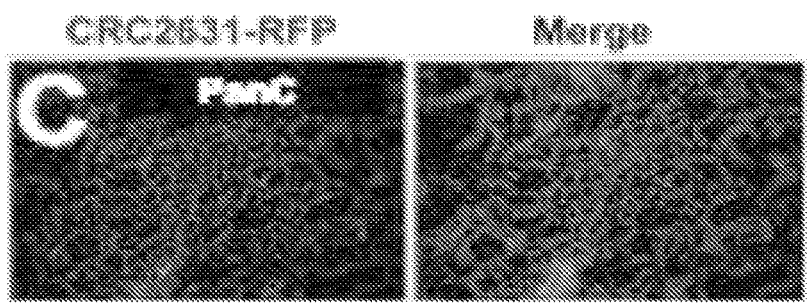

FIG. 10C depicts tumor tissue-specific enrichment of $CRC2631^{iRFP720\text{-}cat}$ in pancreatic cryosectioned tissue sections obtained from tumor-bearing animals. $CRC2631^{iRFP720\text{-}cat}$ fluorescence is shown in the left panel, and this fluorescence is shown in a merge with DNA staining in the right panel.

Figures 10D, 10E:
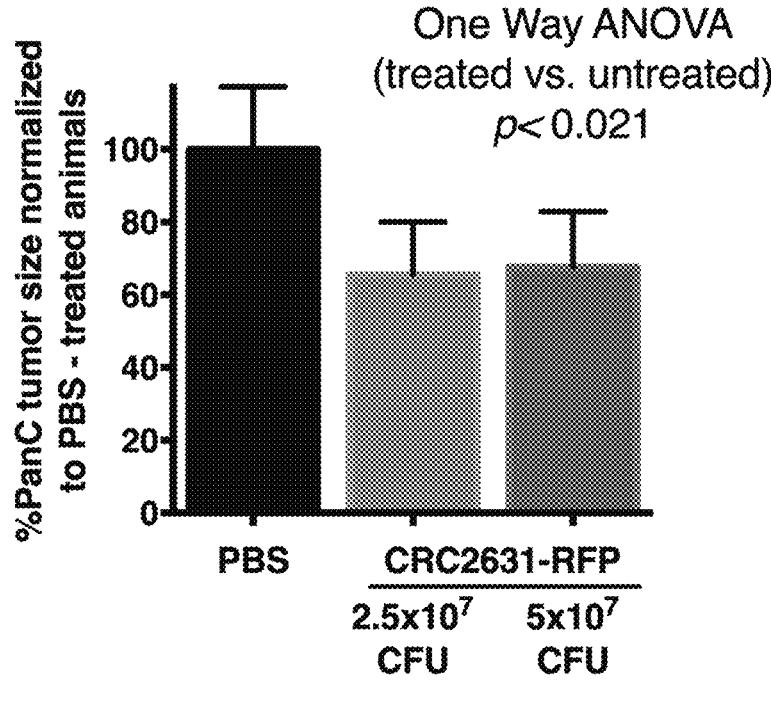

FIG. 10D depicts that PanC-targeted $CRC2631^{iRFP720\text{-}cat}$ notably reduces PanC tumor size. Tumors were harvested from PBS (control) or CRC2631-treated animals and weighed to determine the effect of CRC2631 on tumor size. Weight values were normalized to PBS control groups to establish treatment-induced percent change in tumor weight. P-values were derived from one-way ANOVA t-test.

FIG. 10E depicts that PanC-targeted $CRC2631^{iRFP720\text{-}cat}$ extends animal life at the $5\times10^7$ CFU dose. Kaplan Meyer survival analyses show the overall survival of B6PanC02H7 animals (N=6/group) treated with saline (PBS-no therapy control, dotted line), $2.5\times10^7$ CFU of CRC2631 (dashed line), or $5\times10^7$ CFU of CRC2631 (dashed and dotted line).

Figure 11:
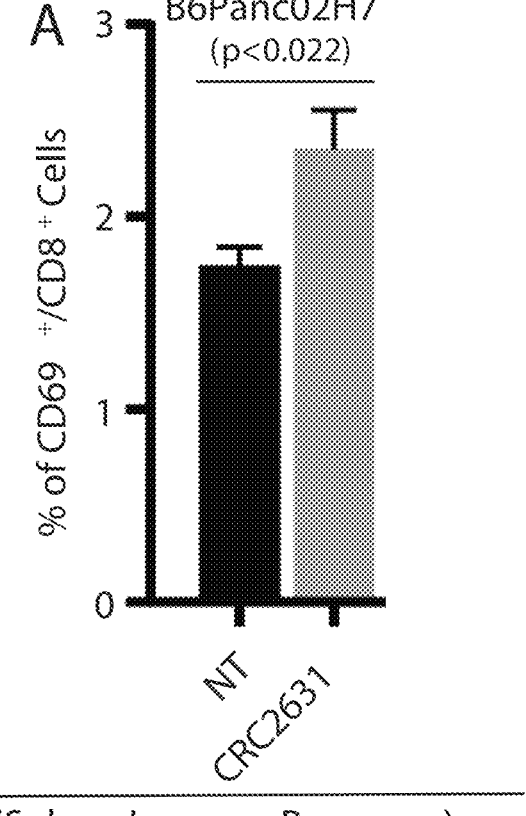

FIG. 11 depicts spleen immune response as the percentage of $CD69^+/CD8^+$ cells for no treatment (NT) control B6Panc02H7 mice and $CRC2631^{iRFP720\text{-}cat}$ treated (CRC2631) B6Panc02H7 mice. It shows that tumor-localized $CRC2631^{iRFP720\text{-}cat}$ activates anti-tumor $CD8^+$ immune cells in the spleen.

DETAILED DESCRIPTION

Conventional chemotherapies are not cancer-specific and as a result generate significant morbidities. Several toxicity-mitigating strategies have previously been proposed, including the use of genetically attenuated bacteria that specifically colonize tumor tissues to deliver therapeutics. However, the lack of bacterial cancer targeting (BCT) strains that are objectively safe continues to limit the clinical utility of these technologies. This is partly because preclinical tumor-targeting and safety evaluations have relied on moderate cancer models in immune suppressed animals. The most studied BCT strain, VNP20009, safely colonized tumors in immune-suppressed animal models but failed to generate a therapeutic signal in human patients, presumably because of rapid immune clearance by the host. The present disclosure describes the toxicological, tumor-targeting, and therapeutic profiles of CRC2631 in a syngeneic mouse model of aggressive prostate cancer (TRAMP). It is shown that CRC2631 is a safe and genetically stable biologic that persistently colonizes tumors, including metastases. Furthermore, the present disclosure also describes how CRC2631 can be used in combination with conventional chemotherapies, immunotherapies, and androgen receptor antagonist therapies to kill cancer cells better than any of the individual treatments.

The present application also discloses the toxicological, tumor-targeting, and efficacy profiles of *Salmonella enterica* serovar *Typhimurium* CRC2631 in a syngeneic and autochthonous TRAMP model of aggressive prostate cancer when used with immune checkpoint inhibitors to trigger anti-tumor immune activity, reducing tumor burden, and improving survival.

The present disclosure also describes how CRC2631 targets and blocks the growth of tumors in a mouse model of pancreatic cancer (B6Panc02H7) and causes an increase in the spleen immune response. This led to life extension in these mice.

CRC2631 was derived from a parent strain (CRC1674) that was isolated in a genetic screen for mutants that selectively kill breast and prostate cancer cells in vitro using the Demerec collection. This collection consists of mutant strains that arose naturally under nutrient-limiting conditions for over four decades, generating a wealth of genetically diverse and potentially attenuated strains. CRC2631 is a biologically pure *Salmonella typhimurium* strain that contains defined naturally occurring genetic alterations, in addition to targeted disruptions of the aroA, thyA, and rfaH genes to improve the strain's tumor-targeting capability and in vivo tolerability. The rfaH deletion disrupts lipopolysaccharide biosynthesis, while the aroA and thyA deletions introduced auxotrophy for aromatic amino acids and thymine.

The TRAMP (Transgenic Adenocarcinoma of Mouse Prostate) model recapitulates some of the key genetic aspects of human prostate cancer. An androgen-dependent promoter drives the expression of simian virus 40 (SV40) large and small T antigens specifically in the mouse prostate epithelium. This leads to the inhibition of p53 and Rb, causing prostatic carcinomas by eight weeks of age. Similar to prostate cancers in men, these murine carcinomas disseminate throughout visceral organs, differentiate into neuroendocrine prostate cancer (NEPC), and ultimately kill the host. While the molecular underpinnings that drive the conversion of carcinomas into NEPC are not well understood, NEPC is associated with loss of the tumor suppressors Rb and p53 in human prostate cancer.

In vitro, CRC2631 selectively colonized cancer cells of diverse histological origins, including breast and prostate cancer cells. Systemic delivery (intravenous or intraperitoneal administration) of CRC2631 in a prostate cancer mouse model (TRAMP) showed tumor-targeted CRC2631 localization. Importantly, CRC2631 triggered the expression and secretion of C-X-C chemokines and cytokines in vitro and in vivo. Congruent with this, CRC2631 elevated the frequency of activated CD4+ cells (CD69+/CD4+) tumor infiltrating lymphocytes (TILs) in prostate tumors and lymph node metastases.

The present disclosure shows that CRC2631 safely and persistently targeted tumor lesions, including metastases. Tumor-targeted CRC2631 induced anti-tumor immune activity and concordantly reduced metastasis burden in the setting of checkpoint blockade. CRC2631 preferentially colonized primary and metastatic tumors in the TRAMP animals. Furthermore, combining checkpoint blockade with CRC2631 extended animal life in TRAMP animals.

Longitudinal genome sequencing data from tumor-passaged CRC2631 revealed minimal genomic evolution. This indicated that CRC2631 is a genetically stable biologic that safely targets tumors.

CRC2631 advantageously destroys human NEPC cells when combined with chemotherapy or ADT in vitro. This therapeutic advantage in combination offers the possibility to generate durable clinical benefits using each agent at subtoxic levels, potentially minimizing treatment-related morbidities. This approach will also broaden the access of chemotherapy and ADT to the NEPC patients market. Therefore, combined with its capacity to kill NEPC cells in chemotherapy or ADT combination treatment settings, CRC2631 as a therapy can promote durable clinical benefits in cancer immunotherapy strategies in a safe and cost competitive manner.

Comparing the toxicity and tumor-targeting profiles of CRC2631 against those of VNP20009 showed that VNP20009 generates more toxicity than CRC2631 and poorly targets tumor tissues in immune-competent TRAMP animals (FIG. 7B-FIG. 7D). Consistent with these observations and in contrast to earlier findings from nude animals, VNP20009 also showed significant toxicity and poor tumor targeting capabilities in an immune-competent mouse model of mammary carcinoma.

CRC2631 partly owes its tolerability and enhanced tumor-targeting characteristics to its unique genomic evolution. CRC2631 was isolated from a collection of naturally occurring mutant strains that arose after maintaining the *Salmonella* LT2 in nutrient-limiting conditions for over four decades. This long-term selection generated a diverse array of genetic alterations while removing the selective pressure to maintain factors that are required for bacterial virulence in a human host. In addition, CRC2631 has disruptions to aroA, rfaH, and thyA genes, which cause deficiencies in lipid polysaccharide biosynthesis (leading to even less toxicity) and auxotrophy for aromatic amino acids and thymine (favoring CRC2631 growth specifically in metabolically rich environments such as cancers). These properties not only augment its tumor targeting but also limit its toxicity. Consistently, CRC2631 was specifically enriched in tumor tissues and did not cause overt toxicity (Table 2A and Table 2B). Additional support for CRC2631 safety and preferential colonization of tumor tissues comes from the findings that CRC2631 is well tolerated in healthy dogs. Serial blood analyses revealed relatively normal organ function (FIG. 8).

In addition to the preferential growth in cancers, other mechanisms likely contribute to CRC2631 tumor tropism. It has previously been shown that *Salmonella* requires wild type serine, aspartate, and ribose chemoreceptors as well as flagellar motility for active targeting of colon carcinoma cylindroids in vitro. Additionally, CRC2631 was screened against a library of human cell surface glycoproteins to identify specific cell surface molecules required for CRC2631-host interaction. CRC2631 was found to bind 10- to >400-fold more efficiently to mannose-linked terminal disaccharide glycoproteins, which are commonly found on cancer cells. This suggests that cancer-specific surface molecules promote the selective entry of CRC2631 into cancer cells.

Longitudinal genome analyses of tumor-passaged CRC2631 showed that CRC2631 remains genetically stable within the tumor microenvironment. At the $2.5 \times 10^7$ CFU dose, mutation rate modeling estimates a 0.15% probability that an average gene within CRC2631 will acquire a mutation inside the host within ten days of treatment. An average gene within CRC2631 would require 100,000 days inside the host to reach the absolute certainty that it will acquire a SNP, which is well beyond the time window of any therapy. A limitation of the modeling approach is that it makes predictions for an average gene within CRC2631 and does not take into account base pair level information for individual genes. It is contemplated that extending the model to this level would require larger samples over deep time points. These modeling data allow one to rationally assign risk levels for specific dosing regimens in other pre-clinical models or in human patients.

Potent CRC2631-based combination treatments were also developed that generate advantageous cell killing effects on treatment resistant prostate cancer cells. Importantly, CRC2631 reduced metastasis incidence in the setting of checkpoint blockade. This is significant because metastasis is the main cause of cancer-associated deaths and no effective immunotherapies against prostate cancer currently exist.

CRC2631 was also demonstrated to have therapeutic effects in the treatment of pancreatic cancer. CRC2631 targeted mouse pancreatic tumors, caused a reduction in tumor size and increase in the mouse spleen immune response, and ultimately led to an extension in lifespan.

Collectively, these findings indicate that CRC2631 is a genetically stable biologic that safely targets tumors, including metastases, in immune-competent hosts.

The present disclosure is directed to a composition comprising a biologically pure isolate of the genus *Salmonella* comprising archival strain CRC1674, wherein the isolate further comprises a disruption of at least one gene selected from the group consisting of aroA, rfaH, and thyA and at least one of a chemotherapy agent, an immunotherapy agent, and an androgen receptor antagonist.

The at least one gene can comprise aroA, rfaH, and thyA.

The disruption can be a deletion of all, parts, or a part of the genomic sequence of aroA, rfaH, thyA, or a combination thereof. The disruption can be via any method of disrupting bacterial genes known in the art, including lambda red recombination and TN10 cassette insertion. The disruption can cause a reduction in bacterial toxicity to humans. The disruption can block completion of bacterial synthetic pathways. The bacterial synthetic pathways can be for the synthetic aromatic amino acids, folic acid, lipopolysaccharide, and nucleic acids. The isolate can further comprise a disruption in one or more other genes that decrease bacteria toxicity to humans including disrupting bacterial synthetic pathways.

The isolate is a genetically stable biologic. This indicates it is not expected to accumulate mutations during the timescales it is used for treatments (i.e. days).

Furthermore, the isolate is tumor-targeting; the isolate preferentially colonizes tumors and tumor metastases compared to normal body tissues.

This isolate can comprise archival *Salmonella enterica* serovar *Typhimurium* strain CRC2631 (Patent Deposit #PTA-126791). The isolate can also comprise derivatives of CRC2631, which are isolates of CRC2631 that have at least one genetic difference from CRC2631 but retain at least 99.9%, at least 99%, or at least 95% sequence identity to strain CRC2631.

The present disclosure is further directed to a method for treating cancer in a patient in need thereof, the method comprising administering an effective amount of a biologically pure isolate of the genus *Salmonella* comprising archival strain CRC1674, wherein the isolate further comprises a disruption of at least one gene selected from the group consisting of aroA, rfaH, and thyA, and a chemotherapy agent, an immunotherapy agent, or a chemotherapy agent and an immunotherapy agent.

More specifically, the present disclosure is directed to a method for treating prostate cancer in a patient in need thereof, the method comprising administering an effective amount of a biologically pure isolate of the genus *Salmonella* comprising archival strain CRC1674, wherein the isolate further comprises a disruption of at least one gene selected from the group consisting of aroA, rfaH, and thyA and a chemotherapy agent, an androgen receptor antagonist, or a chemotherapy agent and an androgen receptor antagonist.

CRC2631 in combination with the chemotherapy agent, immunotherapy agent, androgen receptor antagonist, or combination thereof kills cancer cells more efficiently than CRC2631, chemotherapy agent, immunotherapy agent, or androgen receptor antagonist alone.

For the above methods, the cancer can comprise a primary or metastatic tumor. The metastatic tumor can occur in or on the liver, lymph nodes, kidney, lung, prostate, or adjacent to the primary tumor. The cancer in a patient in need thereof can be a solid cancer (e.g. prostate cancer, pancreatic cancer, breast cancer, etc.). The cancer can preferably be neuroendocrine prostate cancer or pancreatic cancer.

For the above methods, the patient can be a mammal, preferably a human.

For the above methods, the effective amount of the isolate used as a bolus treatment can be at or below the clinically determined maximum tolerated dose.

The chemotherapy agent of the above compositions and methods can comprise birinipant, cabazitaxel, docetaxel, paclitaxel, mitoxantrone, carboplatin, vinorelbine, oftamoxifen, raloxifene, anastrozole, exemestane letrozole, imatanib, cyclophosphamide, lovastatin, minosine, gemcitabine, cytarabine, 5-fluorouracil, methotrexate, gosereline, vincristine, vinblastine, nocodazole, teniposide, etoposide, epithilone, vinorelbine, captothecin, daunorubicin, actinomycin D, mitoxantrone, acridine, doxorubicin, epirubicin, or idarubicin. The chemotherapy agent preferably comprises birinipant, docetaxel, paclitaxel, mitoxantrone, carboplatin, vinorelbine, cabazitaxel, or a combination thereof. The chemotherapy agent preferably comprises docetaxel, birinipant, or a combination thereof.

The immunotherapy agent can in the above compositions and methods comprise an immune checkpoint inhibitor, including Atezolizumab, Avelumab, Durvalumab, Pembrolizumab, Nivolumab, Invivomab®, Ipilimumab, or a combination thereof. The immunotherapy agent can preferably comprise Invivomab®.

The androgen receptor antagonist in the above compositions and methods can comprise bicalutamide, flutamide, enzalutamide, abiraterone, or a combination thereof. The androgen receptor antagonist can preferably comprise enzalutamide.

DEPOSIT INFORMATION

U.S. Pat. No. 8,282,919 is incorporated herein by reference for its description of the CRC2631 microorganism.

The biologically pure isolate of the genus *Salmonella* comprising archival strain CRC1674, wherein the isolate further comprises a disruption of aroA, rfaH, and thyA, is known herein as CRC2631. Strain CRC2631 was deposited on Jul. 21, 2020 at the ATCC® Patent Depository at 10801 University Boulevard, Manassas, Virginia 20110 USA under Patent Deposit #PTA-126791.

U.S. Pat. No. 8,282,919 describes how an inoculum of *S. typhimurium* strain CRC1674 was placed in a sealed glass stab jar containing solid Luria-Bertani (LB) agar in April of 1967. On Jan. 19, 1999, a plug of the agar stab was extracted and grown in LB broth. The mutations found after this archival storage are described in the literature and known in the art and include a G168T mutation of rpoS (RNA-polymerase sigma factor), partial suppression of the hisD2550 auxotrophic mutation in the parent strain, deletion of ten genes located in the membrane region of the microorganism, and substantial changes in one-hundred eighty-two genes amounting to 4.4% of the genome. Strain CRC2631 was produced to reduce archival strain CRC1674 toxicity and make a strain more amenable to human cancer therapies. CRC1674 was produced by disrupting the aroA gene via high-transducing phage P22HT inserting a Tn10 cassette. The TN10 cassette and its use in disrupting bacterial genes is known in the art. The rfaH and thyA genes were deleted via lambda red recombination. Lambda red recombination and its efficient recombination between short homologous sequences are known in the art. aroA is involved in the synthetic pathways relating to aromatic amino acids and folic acid. rfaH is involved in lipopolysaccharide (LPS) synthesis. thyA is involved in the production of nucleic acid precursors.

Primers used complementary to the thyA gene of *S. typhimurium* are provided as SEQ ID NOs: 1-2. Primers used complementary to the rfaH gene of *S. typhimurium* are provided as SEQ ID NOs: 3-4.

The genomic sequence of CRC2631 is provided as SEQ ID NO: 5, and the associated stable pSLT plasmid sequence is provided as SEQ ID NO: 6.

Formulations

The agents and compositions described herein can be formulated by any conventional manner using one or more pharmaceutically acceptable carriers or excipients as described in, for example, Remington's Pharmaceutical Sciences (A. R. Gennaro, Ed.), 21st edition, ISBN: 0781746736 (2005), incorporated herein by reference in its entirety. Such formulations will contain a therapeutically effective amount of a biologically active agent described herein, which can be in purified form, together with a suitable amount of carrier so as to provide the form for proper administration to the subject.

The term "formulation" refers to preparing a drug in a form suitable for administration to a subject, such as a human. Thus, a "formulation" can include pharmaceutically acceptable excipients, including diluents or carriers. Pharmaceutically acceptable excipients for use in the compositions of the present invention are selected based upon a number of factors including the particular compound used, and its concentration, stability and intended bioavailability; the subject, its age, size and general condition; and the route of administration.

The term "pharmaceutically acceptable" as used herein can describe substances or components that do not cause unacceptable losses of pharmacological activity or unacceptable adverse side effects. Examples of pharmaceutically acceptable ingredients can be those having monographs in United States Pharmacopeia (USP® 29) and National Formulary (NF 24), United States Pharmacopeial Convention, Inc, Rockville, Maryland, 2005 ("USP/NF"), or a more recent edition, and the components listed in the continuously updated Inactive Ingredient Search online database of the FDA. Other useful components that are not described in the USP/NF, etc. may also be used.

The term "pharmaceutically acceptable excipient," as used herein, can include any and all solvents, dispersion media, coatings, antibacterial and antifungal agents, isotonic, or absorption delaying agents. The use of such media and agents for pharmaceutical active substances is well known in the art (see generally Remington's Pharmaceutical Sciences (A. R. Gennaro, Ed.), 21st edition, ISBN: 0781746736 (2005)). Except insofar as any conventional media or agent is incompatible with an active ingredient, its use in the therapeutic compositions is contemplated. Supplementary active ingredients can also be incorporated into the compositions.

A "stable" formulation or composition can refer to a composition having sufficient stability to allow storage at a convenient temperature, such as between about 0° C. and about 60° C., for a commercially reasonable period of time, such as at least about one day, at least about one week, at least about one month, at least about three months, at least about six months, at least about one year, or at least about two years.

The formulation should suit the mode of administration. Routes of administration include, but are not limited to, oral, parenteral (e.g., intravenous, intra-arterial, subcutaneous, rectal, subcutaneous, intramuscular, intraorbital, intracapsular, intraspinal, intraperitoneal, or intrasternal), topical (nasal, transdermal, intraocular), intravesical, intrathecal, enteral, pulmonary, intralymphatic, intracavital, vaginal, transurethral, intradermal, aural, intramammary, buccal, orthotopic, intratracheal, intralesional, percutaneous, endoscopical, transmucosal, sublingual and intestinal administration. For example, the agents of use with the current disclosure can be formulated by known methods for administration to a subject using several routes including: parenteral, pulmonary, oral, topical, intradermal, intramuscular, intraperitoneal, intravenous, subcutaneous, intranasal, epidural, ophthalmic, buccal, and rectal. The individual agents may also be administered in combination with one or more additional agents or together with other biologically active or biologically inert agents. Such biologically active or inert agents may be in fluid or mechanical communication with the agent(s) or attached to the agent(s) by ionic, covalent, Van der Waals, hydrophobic, hydrophilic or other physical forces.

The pharmaceutical compositions can be formulated, for example, for oral administration. The pharmaceutical compositions can be formulated as tablets, dispersible powders, pills, capsules, gel-caps, granules, solutions, suspensions, emulsions, syrups, elixirs, troches, lozenges, or any other dosage form that can be administered orally. Pharmaceutical compositions can include one or more pharmaceutically acceptable excipients. Suitable excipients for solid dosage forms include sugars, starches, and other conventional substances including lactose, talc, sucrose, gelatin, carboxymethylcellulose, agar, mannitol, sorbitol, calcium phosphate, calcium carbonate, sodium carbonate, kaolin, alginic acid, acacia, corn starch, potato starch, sodium saccharin, magnesium carbonate, microcrystalline cellulose, colloidal silicon dioxide, croscarmellose sodium, talc, magnesium stearate, and stearic acid. Further, such solid dosage forms can be uncoated or can be coated to delay disintegration and absorption.

The pharmaceutical compositions can also be formulated for parenteral administration, e.g., formulated for injection via intravenous, intra-arterial, subcutaneous, rectal, subcutaneous, intramuscular, intraorbital, intracapsular, intraspinal, intraperitoneal, or intrasternal routes. Dosage forms suitable for parenteral administration include solutions, suspensions, dispersions, emulsions or any other dosage form that can be administered parenterally.

Pharmaceutically acceptable excipients are identified, for example, in The Handbook of Pharmaceutical Excipients, (American Pharmaceutical Association, Washington, D.C., and The Pharmaceutical Society of Great Britain, London, England, 1968). Additional excipients can be included in the pharmaceutical compositions of the invention for a variety of purposes. These excipients can impart properties which enhance retention of the compound at the site of administration, protect the stability of the composition, control the pH, facilitate processing of the compound into pharmaceutical compositions, and so on. Other excipients include, for example, fillers or diluents, surface active, wetting or emulsifying agents, preservatives, agents for adjusting pH or buffering agents, thickeners, colorants, dyes, flow aids, non-volatile silicones, adhesives, bulking agents, flavorings, sweeteners, adsorbents, binders, disintegrating agents, lubricants, coating agents, and antioxidants.

Compounds described herein can be prepared as a salt. "Salt" as used herein refers to pharmaceutically acceptable salts of the compounds described herein which are, within the scope of sound medical judgment, suitable for use in contact with the tissues of humans and lower animals without undue toxicity, irritation, allergic response and the like, and are commensurate with a reasonable benefit/risk ratio. Pharmaceutically acceptable salts are well known in the art. For example, S. M. Berge, et al. describes pharmaceutically acceptable salts in detail in J. Pharmaceutical Sciences, 66:1-19 (1977). Examples of pharmaceutically acceptable salts include, but are not limited to, nontoxic acid addition salts which are salts of an amino group formed with inorganic acids such as hydrochloric acid, hydrobromic acid, phosphoric acid, sulfuric acid and perchloric acid or with organic acids such as acetic acid, maleic acid, tartaric acid, citric acid, succinic acid or malonic acid or by using other methods used in the art such as ion exchange. Other pharmaceutically acceptable salts include, but are not limited to, adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, alkyl having from 1 to 6 carbon atoms, sulfonate and aryl sulfonate Controlled-release (or sustained-release) preparations may be formulated to extend the activity of the agent(s) and reduce dosage frequency. Controlled-release preparations can also be used to effect the time of onset of action or other characteristics, such as blood levels of the agent, and consequently affect the occurrence of side effects. Controlled-release preparations may be designed to initially release an amount of an agent(s) that produces the desired therapeutic effect, and gradually and continually release other amounts of the agent to maintain the level of therapeutic effect over an extended period of time. In order to maintain a near-constant level of an agent in the body, the agent can be released from the dosage form at a rate that will replace the amount of agent being metabolized or excreted from the body. The controlled-release of an agent may be stimulated by various inducers, e.g., change in pH, change in temperature, enzymes, water, or other physiological conditions or molecules.

In other embodiments, the compounds may be prepared as "prodrugs" in a pharmaceutically acceptable composition/formulation. As used herein, the term "prodrug" refers to a derivative of a compound that can hydrolyze, oxidize, or otherwise react under biological conditions (in vitro or in vivo) to provide a compound as described herein. Prodrugs may only become active upon some reaction under biological conditions, but they may have activity in their unreacted forms. Examples of prodrug moieties include substituted and unsubstituted, branch or unbranched lower alkyl ester moieties, (e.g., propionoic acid esters), lower alkenyl esters, di-lower alkyl-amino lower-alkyl esters (e.g., dimethylaminoethyl ester), acylamino lower alkyl esters (e.g., acetyloxymethyl ester), acyloxy lower alkyl esters (e.g., pivaloyloxymethyl ester), aryl esters (phenyl ester), aryl-lower alkyl esters (e.g., benzyl ester), substituted (e.g., with methyl, halo, or methoxy substituents) aryl and aryl-lower alkyl esters, amides, lower-alkyl amides, di-lower alkyl amides, and hydroxy amides. Prodrugs and their uses are well known in the art (see, e.g., Berge, et al. 1977 J. Pharm. Sci. 66:1-19). Prodrugs can typically be prepared using well-known methods, such as those described in Burger's Medicinal Chemistry and Drug Discovery (1995, Manfred E. Wolff ed., 5thed. 172-178, 931-932).

An "effective amount" refers to an amount effective to treat a disease, disorder, and/or condition, or to bring about a recited effect. For example, an effective amount can be an amount effective to reduce the progression or severity of the condition or symptoms being treated. Determination of a therapeutically effective amount is well within the capacity of persons skilled in the art. The term "effective amount" is intended to include an amount of a compound described herein, or an amount of a combination of compounds described herein, e.g., that is effective to treat or prevent a disease or disorder, or to treat the symptoms of the disease or disorder, in a host. Thus, an "effective amount" generally means an amount that provides the desired effect.

The terms "treating", "treat" and "treatment" can include (i) preventing a disease, pathologic or medical condition from occurring (e.g., prophylaxis); (ii) inhibiting the disease, pathologic or medical condition or arresting its development; (iii) relieving the disease, pathologic or medical condition; and/or (iv) diminishing symptoms associated with the disease, pathologic or medical condition. Thus, the terms "treat", "treatment", and "treating" can extend to prophylaxis and can include prevent, prevention, preventing, lowering, stopping or reversing the progression or severity of the condition or symptoms being treated. As such, the term "treatment" can include medical, therapeutic, and/or prophylactic administration, as appropriate.

Unless defined otherwise, all technical and scientific terms used herein have the same meaning as commonly understood by one of ordinary skill in the art to which the disclosure belongs.

EXAMPLES

The following examples are given for purely illustrative and non-limiting purposes of the present invention.

Example 1. Materials and Methods

The following materials and methods were used in all other examples.

Growth of Bacterial Cultures

Table 1 shown below includes a list of bacteria used in these experiments. Isolated colonies of bacteria were grown from −80° C. stock aliquots frozen in 25% glycerol (Fisher Scientific®) on solid or liquid LB media (Fisher Scientific®) containing 200 µg/ml thymine (Arcos Pharmaceuticals) and selective antibiotics [50 µg/mL kanamycin (Sigma®), 50 µg/mL ampicillin (Sigma®), or 20 µg/mL chloramphenicol (Gold Biotechnology®)] as required. Bacteria grown on solid media was incubated for 24-30 h at 37° C. before use. Liquid media cultures were incubated in 50 mL sterile tubes for 20-24 h in a 37° C., 220 rpm dry shaking incubator. Strains grown for injection were washed with sterile phosphate buffered saline (PBS) (Rocky Mountain Biologicals) and concentration adjusted for injection (FIG. 1A, FIG. 1B, and FIG. 1C) and for in vitro cell viability assays.

TABLE 1

| Bacterial strains, mouse models, and cell lines. | |
| --- | --- |
| Genotype | |
| Bacteria | |
| LT2 | Wild-type *Salmonella enterica* serovar Typhimurium strain. |
| CRC1674 | Derived from LT2 strains, hisD2550rpoS. Archived in room temperature agar stab 1958, recovered November 1998. |
| CRC2631 | CRC1674 aroA551::Tn10(Tet$^R$)ΔrfaHΔthyA::pKD4(Kan$^R$) |
| CRC2636 | CRC2631 pRSET-mCherry |
| VNP20009 | *Salmonella enterica* serovar Typhimurium 14028 (YS72 hyperinvasive, xyl-)Δpurl ΔmsbB |
| CRC2631$^{iRFP720\text{-}cat}$ | CRC 1674 aroA::Tn10(Tet$^R$)ΔrfaHΔthyA::P$_{tac}$-iRFP720cat(Cam$^R$) |
| Mouse | |
| C57 TRAMP | C57BL/6-Tg(TRAMP)8247Ng/J (Jax Laboratories) |
| C57 × FvB Tramp | C57BL/6-Tg(TRAMP)8247Ng/J (Jax Laboratories) × FvBNHsd (Envigo) |
| Cell Lines | |
| PC3 | Human prostate cancer cells; derived from metastatic site: bone |
| PC3M | PC3 variant with increased metastatic frequency |
| RWPE1 | Human epithelial prostate cells |
| TRAMP-C2 | Mouse epithelial prostate adenocarcinoma cells |

Cell Lines and Cell Culture Conditions

The cell lines used in these experiments are listed in Table 1. All cell lines were obtained from ATCC® (Manassas, VA). The RWPE-1 cell line was maintained in Keratinocyte Serum Free Medium (K-SFM) media (Gibco®); PC3 cells were grown in Ham's F-12K Medium (Gibco®) supplemented with Fetal Bovine Serum to a final concentration of 10%; and PC3M cells were maintained in RPMI 1640 (Cytiva®) supplemented with 10% FBS, 1 mM sodium pyruvate, 1× non-essential amino acids and 2 mM L-Glutamine. TRAMP-C2 cells were grown according to ATCC® guidelines. All cells were maintained at 37° C. with 5% CO$_2$.

Construction of CRC2631iRFP720-cat

The standard Datsenko and Wanner recombination protocol (Datsenko, K. A. and B. L. Wanner (2000). "One-step inactivation of chromosomal genes in *Escherichia coli* K-12 using PCR products." *Proc Natl Acad Sci USA* 97(12): 6640-6645.) was used to engineer the ΔthyA::Ptac-iRFP720 cat (Cam$^R$) insert into CRC2631, replacing the Kan$^R$ gene cassette at the ΔthyA::pKD4 (Kan$^R$) deletion site to create CRC2631$^{iRFP720\text{-}cat}$ (FIG. 3A). A 50 bp of flanking homology upstream and downstream of the region internal to the CRC2631 ΔthyA::pKD4 (Kan$^R$) insertion was engineered using a megaprimer primer construct to replace the Kan$^R$ gene cassette with a wild-type Ptac promoter, the iRFP720 gene from pBAD/HisB-iRFP720 (Addgene®), and the wild-type cat (Cam$^R$) gene from pRE112. An overnight liquid culture of CRC2631pKD46 was grown in 10 mL of LB+200 µg/ml thymine, 50 µg/mL ampicillin and 50 µg/mL kanamycin at 30° C., 220 rpm dry shaking incubator. A 0.25 mL overnight CRC2631pKD46 culture (1% inoculum) was subcultured into 25 mL LB+200 µg/ml thymine, 50 µg/mL ampicillin, 50 µg/mL kanamycin and 100 mM L-arabinose (Sigma®) media and grown in sterile 50 mL tubes on a 30° C., 220 rpm dry shaking incubator. After 10 h, cells were recovered by 10 min centrifugation at 4000 rpm and washed 4 times in 1 mL cold sterile water, then resuspended in 75 µl sterile 10% glycerol. Using a 0.2 cm electroporation gap cuvette (Fisher Scientific®) 1 μg of insert DNA was electroporated (2.5 kV) (Electroporator 2510, Eppendorf®) into the 10% glycerol CRC2631pKD46 cell suspension. One mL of LB+200 μg/ml thymine was added to the cuvette and the cells were allowed to recover at 37° C. for three hours. The cells were centrifuged at 13.2 k rpm for 1 min, the supernatant discarded, and resuspended in 500 μl LB+200 μg/ml thymine, then spread on selective plates containing LB+200 μg/ml thymine and 7.5 μg/mL chloramphenicol. These plates were incubated for 24 h at 37° C. to recover $Cam^R$ $Kan^S$ transformants. The temperature-sensitive pKD46 helper plasmid was lost by overnight growth at 42° C., growth of 20-200 isolated colonies on LB+200 μg/ml thymine+20 μg/mL chloramphenicol plates, and confirmation of the target $Cam^R$, $Kan^S$, $Amp^S$ antibiotic resistance profile using replica plating. The resulting $Cam^R$, $Kan^S$, $Amp^S$ ΔthyA::Ptac-iRFP720 cat ($Cam^R$) insertion $CRC2631^{iRFP720-cat}$ construct was confirmed by PCR analysis and fluorescence microscopy.

Fluorescence Microscopy of $CRC2631^{iRFP720-cat}$ $CRC2631^{iRFP720-cat}$ was grown for 24 h at 37° C., 220 rpm in LB +200 μg/mL thymine+20 μg/mL chloramphenicol, washed in one volume of PBS, fixed in one volume of PBS+4% paraformaldehyde, washed in one volume PBS, mounted under a glass coverslip at a 1:1 ratio in Vectashield+DAPI (Vector Laboratories) stain, cured in the dark at room temperature for 2 h, sealed, then observed on a Zeiss® Axiovert® 200M fluorescent microscope using a 63× objective with 1.4 NA. A Hamamatsu® Orca-ER monochrome charge-coupled device (CCD) camera was used to take 900 ms Cy5 filter+24 ms DAPI filter exposures, which were pseudocolored and overlaid to confirm fluorescent detection.

Mice

The mouse genotypes used in these experiments are listed in Table 1. Transgenic Adenocarcinoma of Mouse Prostate (TRAMP) mice of pure C57BL/6-Tg(TRAMP) 8247Ng/J (B6) (Jax Laboratories) or hybrid C57BL/6-Tg(TRAMP) 8247Ng/JxFvBNHsd (Envigo) (B6FVB) background were genotyped at 21-28 days of age to distinguish between heterozygous TRAMP(+) animals positive for the PB-Tag SV40 oncogene and TRAMP(−) animals negative for the PB-Tag SV40 oncogene as previously described. B6 and B6FVB TRAMP mice were allowed to grow to 8-31 weeks of age before use in studies. Food [LabDiet®5001 (Lab-Diet®) or AIN-93M (Research Diets®)] and water were provided ab libitum. Animals were observed and weighed on a daily basis during all studies. All animal studies were conducted in accordance with the principles and procedures outlined in the National Institutes of Health Guide for the Care and Use of Animals under the University of Missouri Animal Care and Use Committee supervision (MU IACUC protocols #8602 and #9501).

MRI Imaging

All mice used in toxicity studies were imaged on a Bruker AVANCE III MRI platform. This system has the capability of achieving a 50 μm resolution for imaging tumor models. Mice were anesthetized using 3% isoflurane; anesthesia was maintained with 0.5-2% isoflurane to keep breathing rate at 30 bpm during which axial and coronal scans of the mouse body were performed. Images were taken using Para Vision® 6 software (Bruker BioSpin Inc). Prostate tumor volumes were measured using Imaris® software (Bitplane) to normalize injection groups for an average range of primary tumor burden and to measure therapeutic response to treatment.

Toxicological Studies

All B6FVB TRAMP(+) mice used in toxicity studies were scanned using a Bruker® AVANCE III MRI platform as described above to confirm tumor burden. Mouse tumor burdens were graded by size using the Imaris® software package. Mice were randomly assigned to study groups ensuring that each group had a representative range of tumor burden. Mice groups were injected interperitoneally with up to 5×10^7 CRC2631 or VNP20009 or sterile PBS carrier volume (100-500 μl) or intravenously (tail vein) with 2.5× 10^7 CRC2631 in 200 μl PBS four to fourteen times with a weekly or three-day interval between doses until study completion or until loss of 50% of the group, after which tumor burden was determined using MRI scans and the mice subsequently evaluated for life extension.

Cytokine Assays

Whole blood samples were taken from B6FVB TRAMP (+) mice via saphenous vein draw into capillary tubes containing EDTA anticoagulant (Ram Scientific) 2 h before and 2 h after CRC2631 or VNP20009 injections to measure the innate CRC2631 and VNP20009 inflammatory cytokine response. Blood was placed on ice, and plasma immediately extracted from the whole blood by centrifugation for 10 min at 1000×g in a 4° C. centrifuge followed by transfer of the supernatant to a new Eppendorf® tube. Platelets were removed from the supernatant by centrifugation for 15 min at 2000×g in a 4° C. centrifuge. The resulting plasma supernatant was transferred to a sterile Eppendorf® tube and stored at −80° C. until the cytokines were measured using a Milliplex® xMAP® Mouse High Sensitivity TCell Magnetic Bead Panel kit MHSTCMAG-70K (Millipore®) following the kit protocol on a Luminex 200 system with Xponent® (v2.7). Data analysis was performed using Analyst (Millipore®).

In Vivo Fluorescent Imaging

All mice were fed a defined AIN-93M Mature Rodent diet (Research Diets®) for a minimum of seven days to minimize feed-related autofluorescence in the gastrointestinal system (Inoue, Y., K. Izawa, S. Kiryu, A. Tojo and K. Ohtomo (2008). "Diet and abdominal autofluorescence detected by in vivo fluorescence imaging of living mice." Mol Imaging 7 (1): 21-27.). B6 or B6FVB TRAMP(+) animals were injected either intraperitoneally with 1×10^6 CRC2631 pRSTmCherry or VNP20009 pRSTmCherry, or injected intravenously (tail vein injection) with 1×10^7 or 2.5×10^7 $CRC2631^{iRFP720-cat}$. Fluorescent imaging was performed using a Xenogen IVIS 200 in vivo fluorescence system (Perkin Elmer®) and analyzed using Living Image software (v4.7.3). iRFP720 expression spectral unmixing was performed as previously described to detect $CRC2631^{iRFP720-cat}$ associated iRFP720 in vivo (Shcherbakova, D. M. and V. V. Verkhusha (2013). "Near-infrared fluorescent proteins for multicolor in vivo imaging." Nat Methods 10 (8): 751-754.). Images containing mCherry RFP (FIG. 7A-FIG. 7D) were spectrally unmixed to distinguish the CRC2631 or VNP20009-associated signal in vivo using mCherry spectral unmixing settings in the Living Image software.

Biodistribution Analysis

B6FVB TRAMP(+) mice were injected intravenously (tail vein injections) with 200 μl sterile PBS containing 1.0×10^7 or 2.5×10^7 $CRC2631^{iRFP720-cat}$. Mice were humanely euthanized 190 hours post injection. Whole blood, lung, liver, spleen, kidneys, prostate, and proper axial lymph nodes as well as any discrete metastatic tumor masses were collected, weighed, and kept on ice. Whole blood samples were immediately diluted ¹⁄₁₀ in 25% glycerol and PBS and stored at −80° C. Tissue samples were homogenized in 3 mL sterile PBS for 20 seconds on ice using a TissueRuptor® homogenizer (Qiagen®) with sterile tips, mixed with 3 mL of sterile 50% glycerol, and stored at −80° C. All tissue samples were later thawed, passed through 40 μm sterile filters (BD) and immediately diluted, spotted in triplicate on selective LB+200 μg/ml thymine +20 μg/mL chloramphenicol plates, incubated at 37° C. and enumerated after 24 h following the Miles and Misra method (Hedges, A. J. (2002). "Estimating the precision of serial dilutions and viable bacterial counts." *Int J Food Microbiol* 76(3): 207-214.).

Histopathological Analyses

Histopathological analyses were performed on samples obtained at necropsy from 33-week-old male B6FVB TRAMP(+) mice (four treated with CRC2631, four untreated) to examine the effects of CRC2631 administration on tissues. The four 31-week-old treated mice were given four intraperitoneal injections of 2.5×10⁷ CRC2631 at three-day intervals, and the untreated mice were given 200 μl sterile PBS intraperitoneal injections. Animals were euthanized at the study endpoint (end of week 33) by CO₂ asphyxiation and subsequent exsanguination. The prostate, associated tumor masses, seminal vesicles, urinary bladder, kidneys, adrenal glands, spleen, liver, lung, heart, thymus and lymph nodes that were either visibly enlarged, indicated as having metastatic foci by MRI, or taken in conjunction with other prescribed tissues were collected and immediately fixed in 10% buffered formalin (Fisher Scientific®), paraffin embedded, sectioned (5 μm thick sections), mounted on glass slides and stained with hematoxylin and eosin for histopathologic examinations by light microscopy.

Flow Cytometric Analysis of Infiltrating Lymphocytes

Metastasized lymph nodes were homogenized, and cells were isolated. Immune cell phenotypes were determined via flow cytometry with a FACSAria (BD Biosciences) using the following antibodies: anti-mouse CD3 FITC, anti-mouse CD4 PE, anti-mouse CD8 PerCP/Cyanine 5.5, anti-mouse CD69 APC, and anti-mouse PD1 BV421. All antibodies were purchased from Biolegend®.

RNA Isolation and RNAseq

Prostate cells, benign (RWPE-1) and cancer (PC3 and PC3M) at 80% confluency, were treated with 10⁴ CFU of CRC2631 for 1.5 h at 37° C. and 5% CO₂. Total RNA was isolated from CRC2631-treated and non-treated samples using the RNeasy® Plus kit (Qiagen) as per the manufacturer's protocol. Integrity of RNA was checked on an agarose gel. Libraries were prepared using the TruSeq® RNA Sample Preparation Kit (Illumina®) according to the protocols recommended by the manufacturer, and each library was paired-end sequenced (2×75 bp) by using the NextSeq® High Output Flow Cell—SE75 platform at the University of Missouri DNA Core. Three biological replicates were performed for each sample.

CRC2631-PDL1 Blockade Treatment

To control for tumor burden, 9-12-week-old TRAMP animals were imaged and sorted into four groups (N=12/group). Animals were intravenously infused with PBS, 2.5× 10⁷ CFU of CRC2631, or 0.5 mg Invivomab® (murine anti-PDL1 antibodies; BXCELL, #BE0101) alone or in combination with 2.5×10⁷ CFU of CRC2631. Animals received one injection every three days for a total of four doses. To evaluate the effect of the therapy on tumor size, animals were MRI scanned 21 days after the completion of treatment. These MRI images were used to compare tumor sizes between groups and to determine metastatic incidences in lymph nodes and lungs.

Canine Studies

Four 13-month-old male beagles were administered one dose of 4×10⁶ CRC2631 by intravenous injection. Plasma, saliva, and fecal samples taken pre-administration (0 h) and at 2, 24, 96, and 168 h after CRC2631 administration. A small animal Maxi Panel, which covers glucose (mg/dL), urea nitrogen (mg/dL), creatinine (mg/dL), sodium (mEq/L), potassium (mEq/L), chloride (mEq/L), bicarbonate (mEq/L), anion gap (mEq/L), albumin (g/dL), total protein (g/dL), globulin (g/dL), calcium (mg/dL), phosphorus (mg/dL), cholesterol (mg/dL), total bilirubin (mg/dL), ALT (U/L), ALP (U/L), and CK (U/L), was performed and analyzed by the MU Veterinary Medical Diagnostic Laboratory (Columbia, MO).

Genome Sequencing and Analysis

CRC2631 was grown in a dry shaker in 10 mL of liquid LB +200 μg/ml thymine+50 μg/mL kanamycin for 24 hours at 37° C., 220 rpm. The overnight culture was split. One volume was used for extraction of chromosomal DNA using the standard Wizard genomic DNA prep kit (Promega®) protocol (CRC2631). The other volume was suspended in sterile PBS for intravenous tail injection of 2.5×10⁷ CRC2361 into groups of 11-15-week-old B6 TRAMP mice that were euthanized for tissue collection at 96 or 190 h post CRC2631 injection. Following biodistribution analysis protocols, isolated colonies of CRC2631 were identified after plating prostate tumor tissue homogenates on selective LB+200 μg/ml thymine+50 μg/mL kanamycin plates 24 h at 37° C. These colonies were grown in 10 mL of liquid LB+200 μg/ml thymine+50 μg/mL kanamycin media for 24 h at 37° C., 220 rpm. Four representative TRAMP prostate tumor-passaged overnight cultures from individual mice were used for extraction of chromosomal DNA, as described above (CRC2631a-d). Parental and prostate tumor-passaged chromosomal genomic DNA were sequenced following the standard Next Generation Sequencing NovaSeq® 2×100 protocol (Illumina®) and aligned against the parental LT2 and associated stable pSLT reference sequences (NCBI: NC_003197.2, NC_003277.2) using breSeq (v0.53.1), free-Bayes (v1.3.2), and TIDDIT (v2.10.0) to identify SNP mutations and structural variations present in the tumor-passaged strains (CRC2631a-d) but not in the CRC2631 injection strain. Integrative Genomics Viewer (v.2.8.0) was used to create graphical representations of SNP mutations and structural variations in all sequenced strains.

Mathematical Modeling

The occurrence of a SNP within a 96 h time span was modeled as a Bernouli random variable for each gene within the CRC2631 genome. SNP occurrences across genes were assumed to be independent of one another but not necessarily identically distributed. By Le Cam's theorem, the total number of mutations within CRC2631 within a 96 h time span, denoted X, will be approximately distributed as a Poisson random variable, i.e., X~Poisson(λ). Following a Bayesian approach, λ~Gamma(α,β), with α=1 and β=1, which represents a relatively uninformative prior over the rate parameter λ. For this model, the SNP counts from the three successful CRC2631 strains at 96 h, i.e., three occurrences of two SNPs were used. Thus, the posterior distribution of the rate parameter is λ~Gamma(7,4), with a posterior mean of 1.75 and corresponding 95% credible interval of [0.82, 2.96]. A rate value of 1.75 corresponds to an average gene SNP probability of p̂=0.00038 (for 4548 total genes); likewise, p̂=0.00018 and p̂=0.00065 for the upper and lower bounds of the corresponding 95% credible interval. Under a geometric distribution, these rate probabilities yield an expected value of 10391 days before a SNP in an average gene ($\hat{p}$=0.00038), likewise 22145 days ($\hat{p}$=0.00018) and 6141 days ($\hat{p}$=0.00065).

Cell Viability Assay

Prostate cells ($10^4$ per well) in their respective media were seeded in 96-well plates. The cells were allowed to adhere and recover for approximately 18 h after which they were treated with $10^4$ CFU of CRC2631 for 4 h. At the completion of treatment, media were replaced with gentamycin (40 µg/mL)-containing media for 1 h to eliminate extracellular bacteria. Cells were then washed twice with 1×PBS and cell viability was measured using the MTT Cell Proliferation Assay (ATCC® 30-1010K), as per the manufacturer's recommendation.

Statistical Analyses

All statistical analyses (Student's t test comparisons, ANOVA of mean weight differences over time) were performed using GraphPad Prism® software (v6.0 h).

Example 2. Evaluation of CRC2631 Toxicity

Figure 2B:
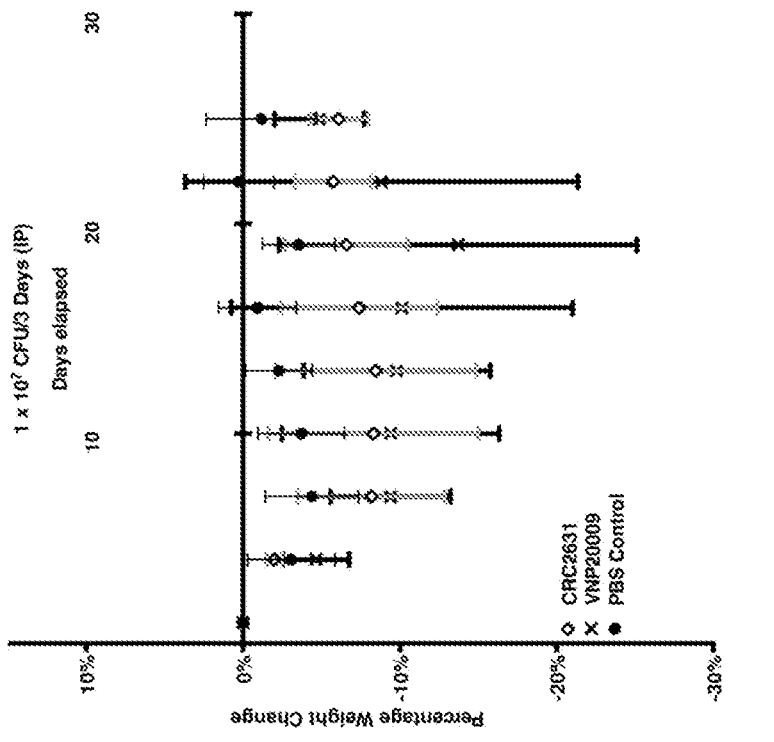
FIG. 2B depicts a comparative toxicological assessment of CRC2631 and VNP20009 using mean group weight change after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Mean weight change of B6FVB TRAMP(+) mice (N=6) IP injected with 1×10⁷ CFU CRC2631, VNP20009, or equal volume PBS dosage every three days for 25 days or until LD50 was reached is shown.
Figure 2A:
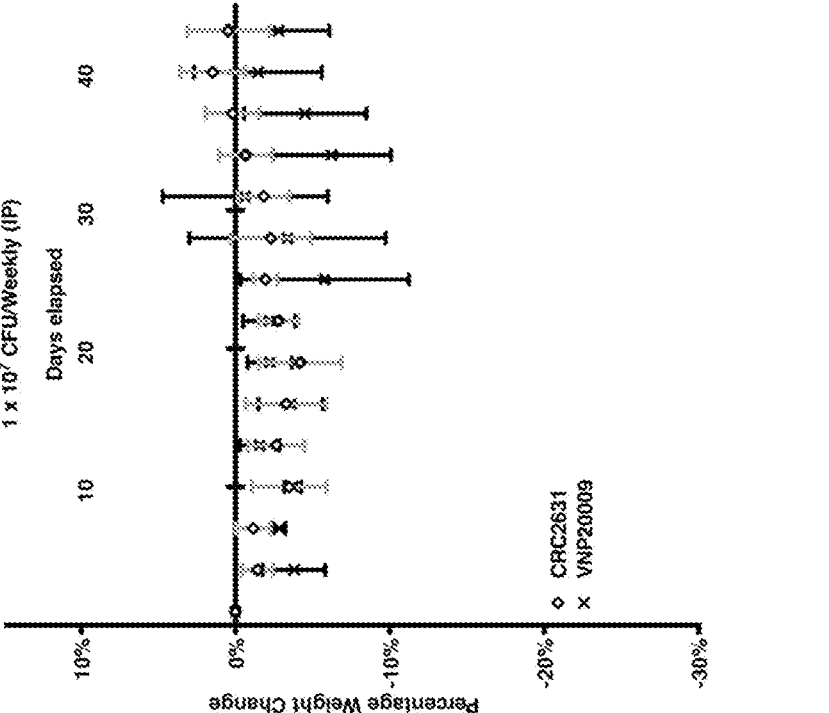
FIG. 2A depicts a comparative toxicological assessment of CRC2631 and VNP20009 using mean group weight change after administration of CRC2631 or VNP20009 intraperitoneal (IP) or intravenous (IV) injections into tumor-bearing B6FVB TRAMP(+) prostate cancer models. All B6FVB TRAMP(+) (Transgenic Adenocarcinoma of Mouse Prostate) model tumor burdens were measured by MRI and mice groups sorted to normalize primary tumor volume size ranges for each dosage group before administration. Mean weight change of B6FVB TRAMP(+) mice (N=4) injected with 1×10⁷ CRC2631 or VNP20009 IP dosage every week for five weeks is shown.
Figure 2C:
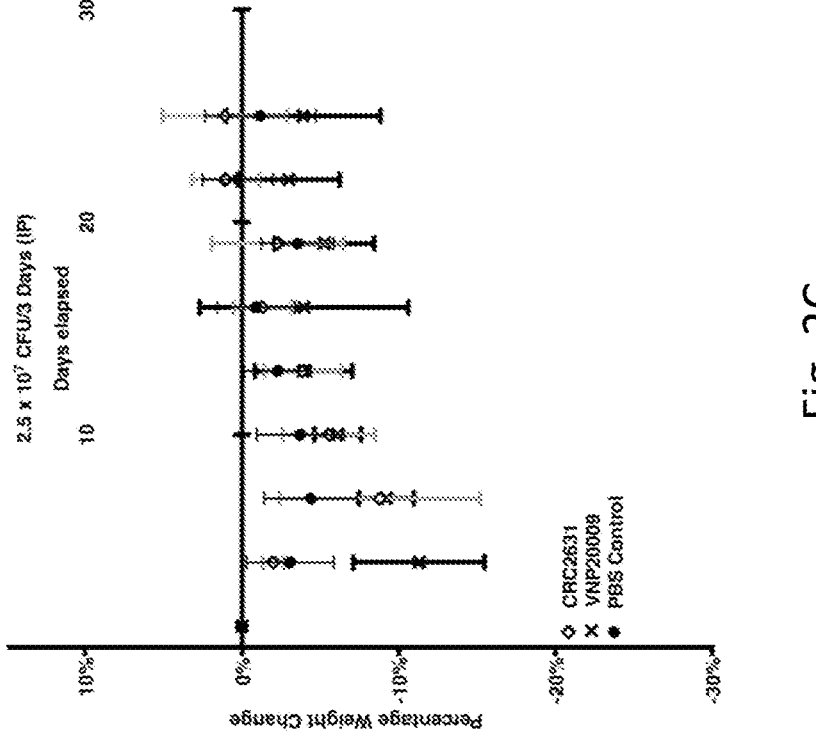
FIG. 2C depicts a comparative toxicological assessment of CRC2631 and VNP20009 using mean group weight change after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Mean weight change of B6FVB TRAMP(+) mice (N=6) IP injected with 2.5×10⁷ CFU CRC2631, VNP20009, or equal volume PBS dosage every three days for 25 days or until LD50 was reached is shown.
Figure 2E:
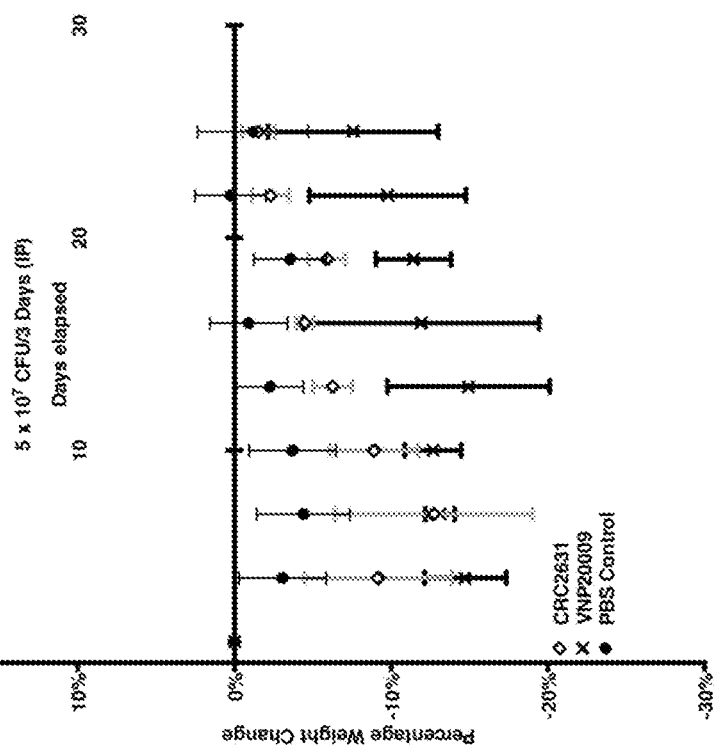
FIG. 2E depicts a comparative toxicological assessment of CRC2631 and VNP20009 using mean group weight change after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Mean weight change of B6FVB TRAMP(+) mice (N=6) IP injected with 5×10⁷ CFU CRC2631, VNP20009, or equal volume PBS dosage every three days for 25 days or until LD50 was reached is shown.
Figure 2D:
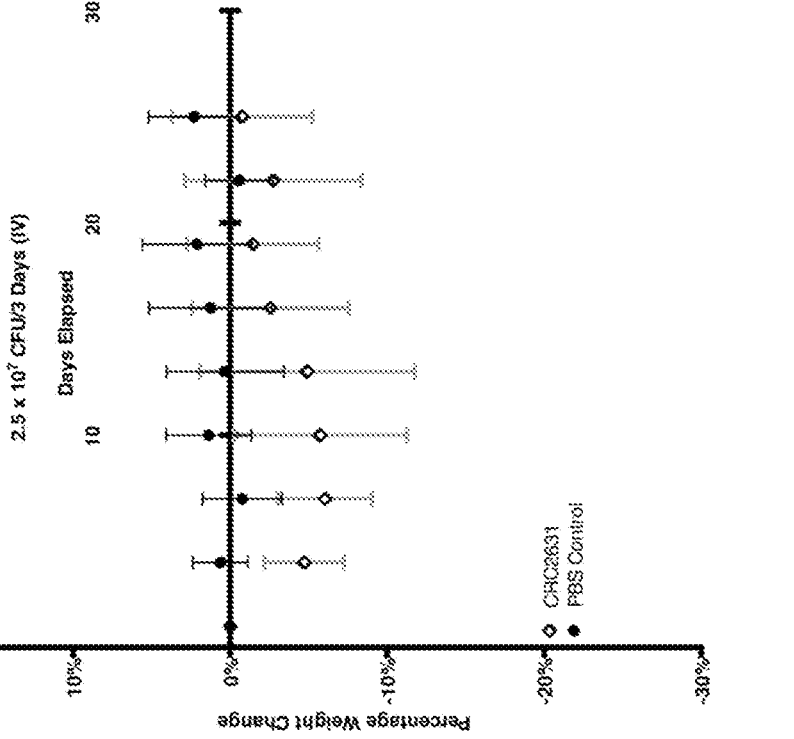
FIG. 2D depicts a comparative toxicological assessment of CRC2631 and VNP20009 using mean group weight change after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Mean weight change of B6FVB TRAMP(+) mice (N=12) IV (tail vein administration) injected with four 2.5×10⁷ CFU CRC2631 or equal volume PBS dosage every three days for 25 days is shown.
Figure 2F:
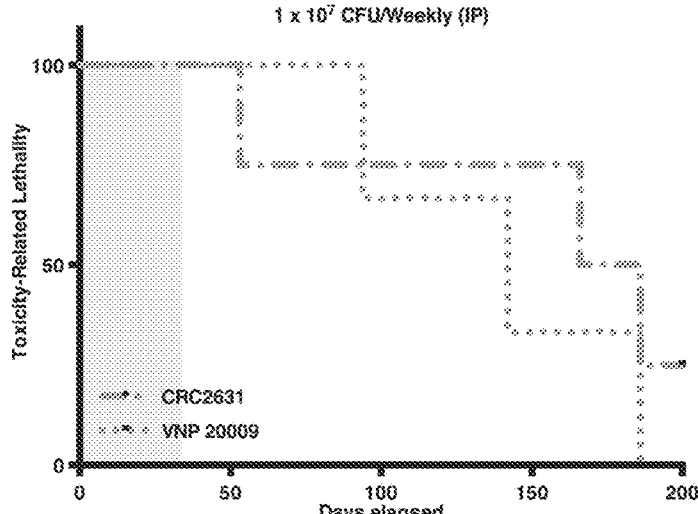
FIG. 2F depicts a comparative toxicological assessment of CRC2631 and VNP20009 using toxicity-related lethality after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Toxicological measure of survival over 200 days of B6FVB TRAMP(+) mice (N=4) IP injected with 1×10⁷ CRC2631 or VNP20009 every week for five weeks is shown. Dosage time period is shaded in gray.
Figure 2G:
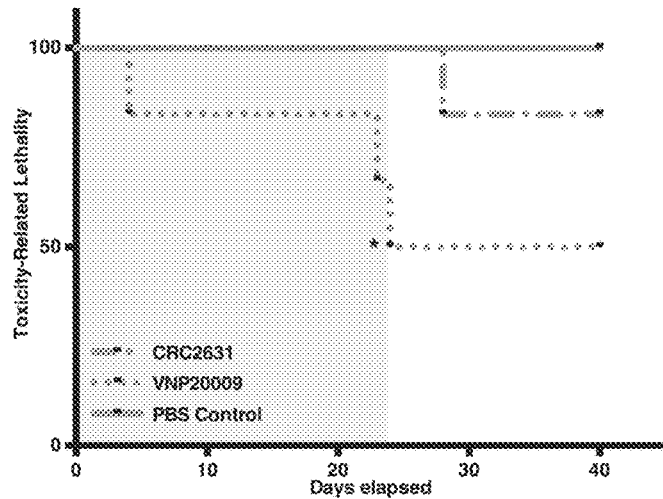
FIG. 2G depicts a comparative toxicological assessment of CRC2631 and VNP20009 using toxicity-related lethality after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Toxicological measures of survival over 40 days of B6FVB TRAMP(+) mice (N=6) IP injected with 1×10⁷ CRC2631, VNP20009, or equal volume PBS dosage every three days for 42 days or until LD50 was reached is shown. Dosage time period is shaded in gray.
Figure 2H:
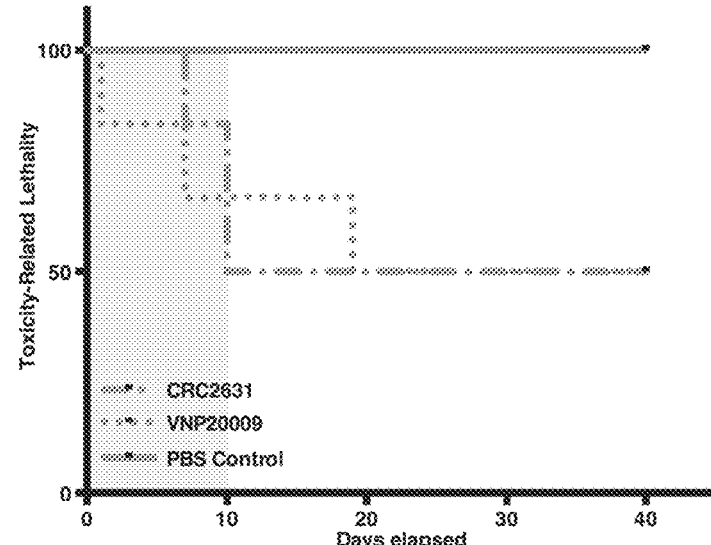
FIG. 2H depicts a comparative toxicological assessment of CRC2631 and VNP20009 using toxicity-related lethality after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Toxicological measures of survival over 40 days of B6FVB TRAMP(+) mice (N=6) IP injected with $5 \times 10^7$ CRC2631, VNP20009, or equal volume PBS dosage every three days for 42 days or until LD50 was reached (*compassionate euthanasia of mouse with >20% weight loss) is shown. Dosage time period is shaded in gray.

VNP20009 is considered as the safety benchmark in bacterial cancer therapy development because it has been safely administered in human cancer patients. To determine the safety profile of CRC2631 and VNP20009 comparative toxicological studies were performed in TRAMP (Transgenic Adenocarcinoma of Mouse Prostate) animals. Treatment-related weight loss and lethality as toxicity measures were focused on. To control for tumor burden, groups of fourteen-week-old B6FVB TRAMP(+) mice were scanned by magnetic resonance imaging (MRI) and assigned either to the CRC2631 (N=4) or the VNP20009 (N=4) group. Animals received four weekly injections of $10^7$ CFU of CRC2631 or VNP20009 intraperitoneally (IP) (see Example 1, FIG. 1A-FIG. 1C), and animal weight was monitored daily for four weeks. CRC2631 and VNP20009 had comparable effects on animal weight loss within the first two weeks of the study. During the last two weeks of the study, however, VNP20009-treated animals progressively lost more weight compared to CRC2631-treated animals (FIG. 2A; p<0.0001, 3.50±1.77% versus 0.11±1.45% weight loss for VNP20009 and CRC2631, respectively). Consistent with CRC2631 being less toxic than VNP20009, the median survival time was 142 days for VNP20009 compared to 186 days for CRC2631 (FIG. 2F). To more rigorously determine the toxicity of CRC2631 and derive its maximum tolerated dose (MTD), the dosing regimen was escalated to $10^7$ or $2.5 \times 10^7$ or $5 \times 10^7$ CFU administered every 3 days, instead of weekly, until 50% group lethality (LD50) was reached. B6FVB TRAMP(+) groups were treated IP or intravenously with a vehicle control (a sterile phosphate buffered saline, PBS) or $10^7$ or $2.5 \times 10^7$ or $5 \times 10^7$ CFU of CRC2631 or VNP20009. Compared to VNP20009, CRC2631 caused less weight loss across all dosage groups over the injection period. The average weight loss percentages for animals treated with $10^7$, $2.5 \times 10^7$, and $5 \times 10^7$ CFU CRC2631 were 7.20±2.45, 3.35±3.58, and 6.69±3.88, respectively. In contrast, VNP20009-treated animals exhibited an average weight loss of 8.99±2.56, 6.13±3.15, and 11.68±2.70 at the corresponding dose levels (FIG. 2B, p<0.0085; FIG. 2C, p<0.0001; FIG. 2D, p<0.0001; FIG. 2E, p<0.0139). Congruent with this, no lethality was observed in the CRC2631 group at the time the VNP20009-treated animals reached LD50 at the $10^7$ CFU/3 day dosage interval level (FIG. 2G). In addition, the VNP20009 group experienced lethality after the first treatment at the $5 \times 10^7$ CFU/3 day dose level, whereas the counterpart CRC2631 group exhibited no lethality until the third treatment when it precipitously reached LD50 (FIG. 2H). This established the MTD at two doses of $5 \times 10^7$ CFU administered three days apart.

To minimize animal stress and thus the likelihood of animal lethality during the study, all the remaining studies were performed below MTD levels (i.e., at $10^7$ CFU or $2.5 \times 10^7$ CFU per animal).

Figure 2J:
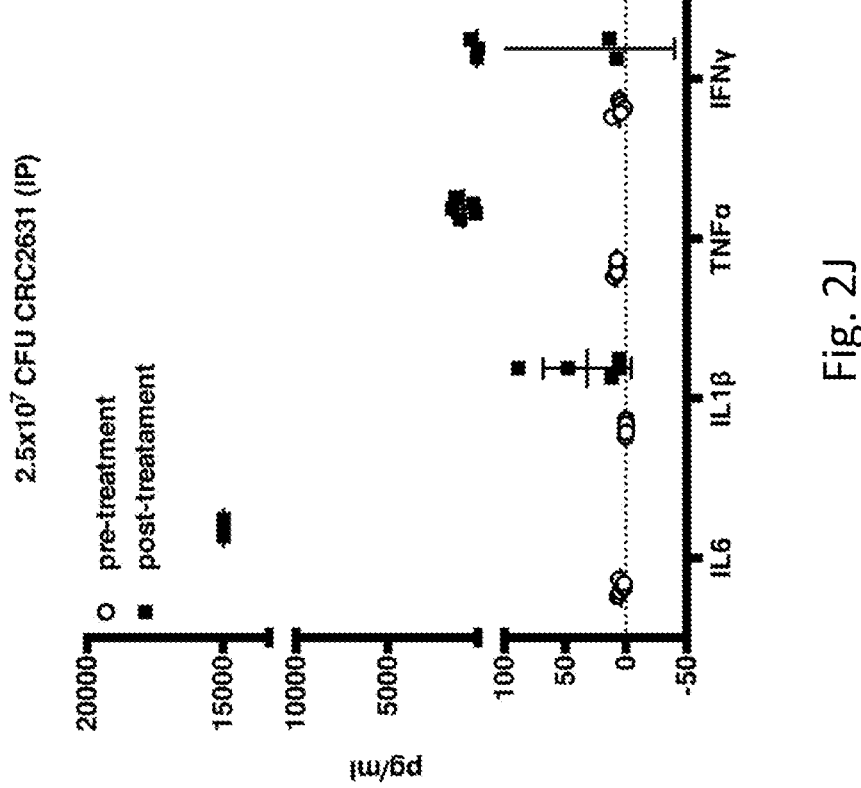
FIG. 2J depicts a comparative toxicological assessment of CRC2631 and VNP20009 using cytokine response after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Inflammatory cytokine (IL-6, IL-1B, TNFα, INFγ) immune response levels in B6FVB TRAMP(+) mice (N=5) plasma two hours before and two hours after first IP injection of $2.5 \times 10^7$ CRC2631 are shown.
Figure 2I:
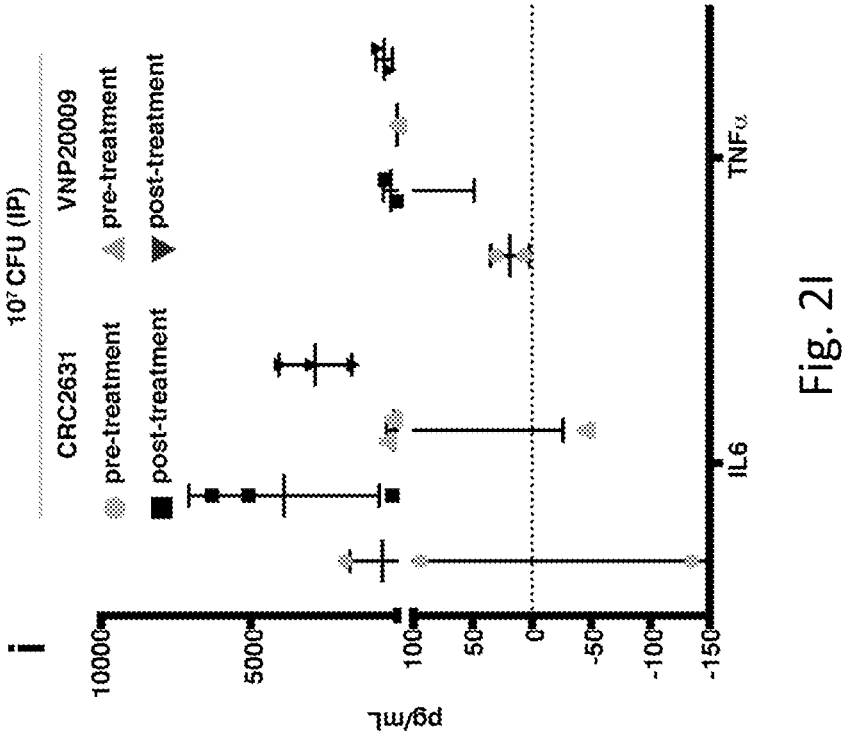
FIG. 2I depicts a comparative toxicological assessment of CRC2631 and VNP20009 using cytokine response after administration of CRC2631 or VNP20009 intraperitoneal (IP) or intravenous (IV) injections into tumor-bearing B6FVB TRAMP(+) prostate cancer models. All B6FVB TRAMP(+) model tumor burdens were measured by MRI and mice groups sorted to normalize primary tumor volume size ranges for each dosage group before administration. Inflammatory cytokine (IL-6, TNFα) immune response levels in B6FVB TRAMP(+) mice (N=3) plasma two hours before and two hours after first IP injection of $1 \times 10^7$ CRC2631 or VNP20009 are shown.

The next focus was whether the tolerability of CRC2631 was due to poor immunogenicity, and it was not. CRC2631 and VNP20009 treatments triggered comparable cytokine responses in TRAMP B6FVB mice (FIG. 2I-FIG. 2J).

Bacteria are cleared out of the blood circulation via the liver. VNP20009 causes significant liver toxicity. Thus, the impact of CRC2631 on the liver was established using histopathological approaches. Two groups of 31-week-old B6FVB mice (N=4) were treated IP with 4 doses of $2.5 \times 10^7$ CRC2631 or 200 µl PBS (control) at three-day intervals. Liver histological sections were prepared eleven days after treatment initiation (i.e., in 33-week-old animals) and stained with hematoxylin and eosin (H&E). Examination of H&E stained sections by a veterinary pathologist revealed normal hepatic architecture in treated and non-treated mice (Table 2A and Table 2B). Findings not related to CRC2631 administration and interpreted as insignificant included mild, multifocal inflammatory cell (mononuclear and less commonly granulocyte) infiltrates without associated alterations of adjacent hepatocytes. One mouse in the untreated group had sub-massive coagulative necrosis and congestion of the caudate liver lobe, but this was interpreted to be an incidental lesion and not attributable to treatment group. These analyses were extended to lungs, kidneys, and lymph nodes, and no CRC2631-related tissue anomalies were found (Table 2A and Table 2B). Thus, it was concluded that CRC2361 does not cause liver disease and, more broadly, it does not destroy non-targeted host tissues. Table 2A and Table 2B are shown below for ease of reference. They show a histopathological analysis of non-targeted tissues in CRC2631 administered B6FVB TRAMP(+) mice. Histopathological analysis was performed on samples obtained at necropsy from groups (N=4) of 33-week-old B6FVB TRAMP(+) males to examine the effects of CRC2631 administration on non-targeted tissues. Groups were injected intraperitoneally with PBS (no treatment; Table 2A) control or $2.5 \times 10^7$ CRC2631 (treatment; Table 2B) to examine the effects of CRC2631 administration on non-targeted tissues. Kidneys, liver, lung, and lymph node tissues were collected, mounted on glass slides and stained with hematoxylin and eosin (H&E) for histopathologic examinations by light microscopy.

TABLE 2A

| No Treatment Group: B6FVP TRAMP Mice, Four Doses PBS (3 Day Intervals) | | |
|---|---|---|
| Tissue | Gross Observations | H&E Stain Observations |
| Animal ID: AF5963 | | |
| Right kidney | | Mild peripelvic and perivascular mononuclear cell infiltrate |
| Right renal lymph node | Mildly enlarged | Moderate central necrosis and infiltration by cancer cells (50% visible tissue necrosis in section) |
| Liver (caudate lobes) | Dark red | 80% of tissue has parenchymal necrosis (largely sparing portal triads), marked congestion |

TABLE 2A-continued

| No Treatment Group: B6FVP TRAMP Mice, Four Doses PBS (3 Day Intervals) | | |
|---|---|---|
| Tissue | Gross Observations | H&E Stain Observations |
| Liver | | Mild, multifocal mononuclear cell infiltrate, granulocytic cell infiltrates |
| Left kidney | | Several peripelvic foci of cancer cells |
| Left renal lymph node | Mildly enlarged | Cancer cell infiltration, marked central necrosis (70% visible tissue necrosis in section) |
| Left lumbar aortic lymph node | Moderately enlarged | Cancer cell infiltration |
| Lungs | | Several small cancer foci |
| Animal ID: KQ2130 | | |
| Left kidney | | Mild focal peripelvic mononuclear cell infiltrate |
| Liver | | Very mild multifocal mononuclear cell infiltrate |
| Lungs | | Large focus of cancer cells adherent to large vessel endothelium |

TABLE 2A-continued

| No Treatment Group: B6FVP TRAMP Mice, Four Doses PBS (3 Day Intervals) | | |
|---|---|---|
| Tissue | Gross Observations | H&E Stain Observations |
| Animal ID: PV3912 | | |
| Right kidney | | Focus of peripelvic mononuclear cells |
| Liver | | Rare mononuclear cell infiltrate |
| Left kidney | | Moderate peripelvic mononuclear cellular infiltrate |
| Animal ID: AF5965 | | |
| Right kidney | | Mild to moderate perivascular and peripelvic mononuclear cell infiltrate |
| Lumbar aortic or iliac lymph node | Moderately enlarged | Infiltration by cancer cells (10% visible tissue necrosis in section) |
| Liver | | Mild mononuclear cell infiltrate |
| Left kidney | | Mild peripelvic mononuclear cell infiltrate |

TABLE 2B

| Treatment Group: B6FVB TRAMP Mice, Four Doses $2.5 \times 10^7$ CRC2631 (3 Day Intervals) | | |
|---|---|---|
| Tissue | Gross Observations | H&E Stain Observations |
| Animal ID: FK8038 | | |
| Right kidney | | Mild multifocal peripelvic and perivascular mononuclear cell infiltrates |
| Left kidney | | Mild multifocal peripelvic and perivascular mononuclear cell infiltrates |
| Mesenteric lymph node | Mildly enlarged | Mild hyperplasia |
| Liver | | Mild multifocal granulopoesis, mild multifocal mononuclear cell infiltrate |
| Lungs | | Several foci of cancer cells |
| Animal ID: PV3915 | | |
| Right kidney | | Several foci of cancer cells near pelvis and perivascular, moderate hydronephrosis, mild peripelvic mononuclear cell infiltrate |
| Right renal lymph node | Markedly enlarged | Cancer cells, 10% of visible tissue necrosis in section |
| Liver | Cellular material/fibrin, necrotic debris between liver and GI tract. Possible reactive mesothelial cells. | Moderate multifocal mononuclear cell infiltrate, mild multifocal granulocytic cell infiltrates, mild multifocal granulopoesis |
| Animal ID: FK8027 | | |
| Left kidney | | Multifocal mononuclear cell infiltrate near pelvis |
| Right axillary or accessory lymph node | Markedly enlarged | Cellular infiltrate appears to be 100% cancer cells (5% visible tissue necrosis in section) |
| Right renal lymph node | Mildly enlarged | Cellular infiltrate (100% cancer cells) |

TABLE 2B-continued

| | Treatment Group: B6FVB TRAMP Mice, Four Doses 2.5 × 10^7 CRC2631 (3 Day Intervals) | |
|---|---|---|
| Tissue | Gross Observations | H&E Stain Observations |
| Liver | | Mild multifocal granulopoesis, mild multifocal mononuclear cell infiltrate/granulocytic cell infiltrates |
| Cranial mediastinal lymph node | Moderately enlarged | Mild to moderate hyperplasia, possible focus of cancer cells |
| Lung | | Focus of cancer cells |
| | Animal ID: KQ2133 | |
| Subiliac lymph node | Moderately enlarged | Moderate hyperplasia |
| Right kidney | | Mild focal peripelvic cellular infiltrate |
| Liver | | Mild to moderate multifocal perivascular and periportal cellular infiltrate, mild multifocal mononuclear cell infiltrate/granulocytic cell infiltrates |
| Lungs | | No significant lesions; cancer in bronchiolar epithelium. |

Example 3. CRC2631 Preferentially Colonizes Primary Tumors and Metastases

Next, it was sought to determine the in vivo tumor-targeting capability of CRC2631 in TRAMP animals.

First, a strategy was devised that not only permitted longitudinal detection of CRC2631 in live-treated animals using fluorescence imaging but also made it possible to selectively isolate CRC2631 from harvested organs for quantitative bio-distribution assays.

The fluorescence reporter iRFP720 and a chloramphenicol resistance cassette were introduced into CRC2631, generating CRC2631$^{iRFP720-cat}$. The kanamycin resistance cassette inserted into the ΔthyA deletion site was replaced with a gene fusion that constitutively expresses the iRFP720 fluorescent protein (Shcherbakova, D. M. and V. V. Verkhusha (2013). "Near-infrared fluorescent proteins for multicolor in vivo imaging." Nat Methods 10 (8): 751-754.) and the cat chloramphenicol resistance cassette (FIG. 3A). In comparison to CRC2631, CRC2631$^{iRFP720-cat}$ produced visible iRFP720 fluorescence signal and grew in chloramphenicol media, making it suitable for in vivo tumor-targeting studies.

Two groups (N=3) of B6FVB TRAMP(+) animals were scanned by MRI to establish tumor burden. All of the B6FVB TRAMP(+) animals exhibited prostate tumors and metastases to various visceral organs (FIG. 3K-FIG. 3V); one animal had several metastatic masses in the peritoneal cavity (FIG. 3S-FIG. 3T). To determine CRC2631$^{iRFP720-cat}$ tumor-targeting capabilities, these animals received IV injections of 10^7 or 2.5×10^7 CFU of CRC2631$^{iRFP720-cat}$. One additional B6FVB mouse was included in each dose group (AK5290 and KT6638 for the 10^7 and 2.5×10^7 CFU groups, respectively) as a fluorescence background control.

First RC2631$^{iRFP720-cat}$ bio-distribution was determined at 96 hours and 190 hours post injection (hpi) by detecting the iRFP signal of CRC2631$^{iRFP720-cat}$ at the indicated time-points using the fluorescence in vivo imaging system (IVIS). In both dosage groups, iRFP signals were detected above background in two of the three animals treated with CRC2631$^{iRFP720-cat}$. High intensity iRFP foci were detected in the prostate and peritoneal cavity regions at 96 hpi (FIG. 3B-FIG. 3C). These signals coincided with the positions of primary and metastatic legions in from MRI images and persisted for over three days (190 hpi) (FIG. 3G-FIG. 3H), suggesting that CRC2631$^{iRFP720-cat}$ preferentially colonized tumor tissues.

To confirm this, CRC2631$^{iRFP720-cat}$ load was determined in tumor tissues (prostate and bulk metastases), blood, lung, lymph nodes, liver, spleen, and kidneys harvested from the 190 hpi animals above (detection thresholds for the aforementioned tissues were 6.58×10^1, 1×10^3, 6.73×10^3, 4.86× 10^4, 2.63×10^2, 9.69×10^3, and 4.70×10^2 CRC2631$^{iRFP720-cat}$ counts per gram tissue, respectively). The indicated tissues were harvested and their respective counts of CRC2631$^{iRFP720-cat}$ per gram of tissue were determined under chloramphenicol selection (see Example 1).

Detectable CRC2631$^{iRFP720-cat}$ was enriched in the prostate at the 10^7 and 2.5×10^7 CFU dosing levels (FIG. 3D-FIG. 3F, FIG. 3I-FIG. 3J). Two out of three animals in the 10^7 CFU group had detectable colonies only from the prostate and liver tissues. One animal in the 2.5×10^7 CFU group (i.e., QA2140) did not yield any colony in the analyzed tissues; however, the remaining two animals (VF2749 and AK5289) showed higher colony counts in the prostate and bulk metastases compared to the remaining tissues (FIG. 3I-FIG. 3J). No detectable CRC2631$^{iRFP720-cat}$ counts were present in whole blood. Comparing bacterial load in the liver versus in tumor tissues provides a measure of tumor-targeted bacterial colonization. The prostate to liver ratio of CRC2631$^{iRFP720-cat}$ counts ranged from 20:1 to 18000:1 and 1220:1 to 1690:1 in the 10^7 CFU and 2.5×10^7 CFU treated animals, respectively (FIG. 3D-FIG. 3F, FIG. 3I-FIG. 3J). Two (VF2749 and AK5289) of the three animals in the 2.5×10^7 CFU dose group exhibited several prominent metastases (FIG. 3S-FIG. 3U) and the metastases to liver CRC2631$^{iRFP720-cat}$ count ratio ranged from 1640:1 to 2990:1 (FIG. 3I-FIG. 3J). Taken together, these data indicate that CRC2631$^{iRFP720-cat}$ targets primary tumors and metastases.

Example 4. CRC2631 is Genetically Stable Inside the Host

The genetic alterations that attenuate CRC2631 and contribute to its tumor-targeting capability are permanently integrated in its genome. This reduces the likelihood that CRC2631 will regain toxicity and/or lose its tumor targeting capability due to de novo mutations inside the host environment; however, it remained a possibility. To determine the genetic stability of CRC2631 inside the host, longitudinal whole genome sequencing and short nucleotide polymorphism (SNP) analyses of CRC2631 were performed prior to treatment and tumor-passaged CRC2631 in B6 TRAMP(+) mice. Animals (N=4) were treated intravenously with CRC2631 ($2.5 \times 10^7$ CFU), and then CRC2631 was isolated from prostate tissues harvested at 96 or 190 hpi. Three isolates were recovered from the 96 hpi (CRC2631a-c), and one isolate was recovered from the 190 hpi (CRC2631d) prostate tissues (Table 3). Genomic DNA libraries were produced for all samples and sequenced using NovaSeq® 2×100 lane kit protocols (Illumina®). SNPs identified in reads assembled and mapped against the CRC2631 parental LT2 (NCBI: NC_003197.2) and associated stable pSLT plasmid (NCBI: NC_003277.2) sequences using breSeq (v0.53.1), freeBayes (v1.3.2) and TIDDIT (v2.10.0) to identify SNP mutations and structural variations present in the tumor-passaged strains (CRC2631a-d) but not in the CRC2631 injection strain. "0/0" indicates no mutation in daughter strain compared to CRC2631 injection strain; "0/1" indicates a SNP mutation in daughter strain compared to CRC2631 injection strain; "1/1" indicates a SNP mutation in CRC2631 daughter strain that reverts back to the original LT2 sequence compared to CRC2631 injection strain. Table 3 indicating mutations is shown below for reference.

(CCTGTT) in an intragenic region between pSLT064 and ssbB of the LT2-associated plasmid (pSLT) (FIG. 4C).

The observed low SNP frequency in tissue-passaged CRC2631 over an ~8 day period suggested that CRC2631 is genetically stable within the host. To evaluate the robustness of CRC2631 genetic stability, the time it would take for CRC2631 to experience a SNP in any gene of interest was first estimated. The LT2 lineage of the CRC2631 genome (including the stably associated pSLT plasmid) consisted of ~4951383 base pairs organized in ~4548 predicted gene coding sequences. The average size of the gene coding sequences is 943.89 bp (McClelland, M., K. E. Sanderson, et al. (2001). "Complete genome sequence of *Salmonella enterica* serovar *Typhimurium* LT2." *Nature* 413 (6858): 852-856.). Considering the observed SNP frequency rate (51.83±7.67 hours/SNP), it would take ~9375 days for CRC2631 to acquire a SNP in any specific gene by chance. In a complementary approach, the risk probabilities of such an event over time was modeled (see Example 1). This model predicted that the probability of an average gene accumulating a first SNP after 10, 100, 1000, 10000 and 100000 days to be: 0.0015, 0.01, 0.0921, 0.6181, and 0.9999, respectively (FIG. 4D). The probability that CRC2631 will gain 0, 1, 2, 3, 4, and 5 mutations four days after treatment is predicted to be 0.21, 0.29, 0.23, 0.14, 0.07, and 0.03, respectively. Thus, CRC2631 is a stable tumor-targeting biologic.

Example 5. CRC2631 Reduces Metastatic Incidence in Combination with Immunotherapies Like Checkpoint Blockade Therapies The observations that CRC2631 stably colonized tumors, including metastases, prompted exploration of the possibil-

TABLE 3

| Reference Genome | SNP Position (Gene) | (96hpi) CRC2631a | (96hpi) CRC2631b | (96hpi) CRC2631c | (190hpi) CRC2631d |
|---|---|---|---|---|---|
| NC_0031972 | 1110887 (STM1021) | 0/1 | 0/1 | 0/1 | 0/1 |
| NC_0031972 | 1111253 (STM1021) | 0/1 | 0/1 | 0/1 | 0/1 |
| NC_0032772 | 53704 (intragenic) | 0/0 | 0/0 | 0/0 | 1/1 |

DNA was isolated and Illumina® Next Generation Sequencing (NGS) was performed on 0 hpi CRC2631 (prior to treatment) and all tumor-passaged isolates to identify SNP mutations occurring in the host environment. Comparisons of the 96 hpi or 190 hpi versus the 0 hpi sequences identified a total of two and three SNPs at 96 hpi and 190 hpi, respectively. The three 190 hpi SNPs include the same two SNPs identified at 96 hpi. To map these SNPs to specific genes, genome information from the *Salmonella enterica* serovar *Typhimurium* LT2 strain (GenBank®: AE006468.2) and its associated pSLT plasmid (GenBank®: AE006471.2) was annotated. There is no annotated genome information currently available for CRC2631, and CRC2631 is a direct derivative of LT2. With the exception of one SNP that mapped to an intergenic region, all of the remaining variants represented synonymous SNPs. The two 96 hpi SNPs mapped to two distinct positions in the STM1021 locus, which is similar to the Gifsy-2 lysogenic bacteriophage region (ninG) in the LT2 genome (FIG. 4A-FIG. 4B). The unique 190 hpi SNP consisted of a six base-pairs deletion ity that CRC2631 reduces tumor burden in TRAMP animals. The inventors previously reported that low doses of CRC2631 ($10^7$ CFU administered weekly) modestly reduced prostate tumor size in TRAMP animals (Kazmierczak, R. A., B. Gentry, T. Mumm, H. Schatten and A. Eisenstark (2016). "*Salmonella* Bacterial Monotherapy Reduces Autochthonous Prostate Tumor Burden in the TRAMP Mouse Model." *PLOS One* 11(8): e0160926.). The first line of inquiry was whether CRC2631 generates a more robust therapeutic response at a higher CRC2631 dose. Pre- and post-treatment MRI images were used to compare tumor size in response to therapy. Groups (N=12) of 8-10-week-old B6FVB TRAMP(+) animals were treated with PBS (control) or $2.5 \times 10^7$ CFU CRC2631 administered intravenously every three days for a total of four treatments. Prostate tumor size was scored in control versus CRC2631-treated animals 21 days after treatment initiation, and CRC2631 did not significantly reduce prostate tumor size, compared to the PBS control (FIG. 5A; p<0.6799, 30.77 mm³±76.07 versus 42.30 mm³±52.79 respectively). CRC2631 targeted and directly killed murine and human prostate cancer cells in vitro (FIG. 6), raising the possibility that unknown resistance mechanisms protect tumor cells from CRC2631-mediated cell death in vivo. These inhibitory signals may be tumor cell-intrinsic and/or involve the tumor immune microenvironment.

Tumor-localized CRC2631 failed to reduce the size of primary prostate tumors in TRAMP animals. This could be due to a sub-optimal intra-tumoral CRC2631 load; a higher and safe dosing regimen and/or direct intra-tumoral CRC2631 delivery could be used. This result also could be due to the aggressiveness of the TRAMP model. In contrast to mouse cancer models where oncogenesis is triggered in a limited number of cells over a defined time interval, androgen-driven expression of SV40 antigens transforms prostatic tissues more broadly and continuously, leading to sustained and rapid tumor overgrowth. This may potentially mask a CRC2631 tumor suppressive effect. Prostate cancers progress more slowly in human patients. It is contemplated that the evaluation of CRC2631 therapeutic profile to other tumor models would be informative.

Concerning an interaction between CRC2631 and immune cells, the next line of inquiry was whether tumor-targeted CRC2631 generates an anti-tumor immune response that tumors rapidly inhibit via immune checkpoint mechanisms. Tumor cells express program death ligand-1 (PDL1), which interacts with PD1 on the surface of immune T-cells to inhibit anti-tumor immune activities.

RNA sequencing data showed an upregulation of immunogenic chemokines and cytokines (CXCL, CSF2, IL6, and TNF) in human prostate cancer cells (PC3, PC3M) or mice treated with CRC2631 (FIG. 5B and FIG. 2I-FIG. 2J, respectively). Similar to humans, TRAMP animals develop a robust immunosuppressive microenvironment in prostate tumors, which were thought to likely mask the effect of CRC2631. Thus, distant metastases were focused on to determine whether metastases-targeted CRC2631 recruits and activates tumor-infiltrating lymphocytes (TILs) in vivo. TRAMP animals develop unambiguous lymph node and visceral organ metastases that can be readily detected in MRI images (FIG. 3K-FIG. 3V). Lymph nodes containing MRI-verified metastases were harvested either from CRC2631-treated or PBS control TRAMP animals. Flow cytometric analyses showed that CRC2631 significantly elevated the frequency of activated CD4$^+$ (CD69$^+$/CD4$^+$) TILs in metastasized lymph node tissues (FIG. 5C). CD4$^+$ TILs mediate an anti-cancer immune response by activating tumoricidal CD8$^+$ T-cells. In contrast, regulatory T-cells (T$_{reg}$) suppress CD8$^+$ T-cells. CRC2631 treatment did not enhance T$_{reg}$ frequency compared to PBS control tissues. Interestingly, histological analyses did not show an increase of CD8$^+$ TILs in metastasized lymph nodes or lungs derived from the therapy animals compared to controls, suggesting T-cell exhaustion. Congruently, CRC2631 increased the proportion of CD4$^+$ TILs expressing the exhaustion marker PD1 (CD4$^+$ PD1$^+$) (FIG. 5D). Targeted inhibition of the PDL1-PD1 signaling axis restores anti-cancer immune activity and generates significant clinical benefits in patients with immunogenic cancers. The observations of the present disclosure suggest that CRC2631 may reduce tumor burden by enabling an anti-tumor immune response in the PDL1/PD1 blockade setting.

Eight-to-ten-week old animals (N=12) were scanned by MRI to control for tumor burden across groups. These animals were treated with 200 µL of PBS (vehicle control) or CRC2631 (2.5×10$^7$ CFU) or murine anti-PDL1 antibodies (Invivomab®, 0.5 mg) or a cocktail of CRC2631-Invivomab®. The dosing regimen consisted of a single dose of the indicated treatment every three days for a total of four infusions. Twelve to fourteen weeks after the last infusion animals received a single boost dose. Post-treatment lung and lymph node MRI images were used to enumerate and compare metastasis incidence across groups at 21 days after treatment (FIG. 5E-FIG. 5F). PBS control animals showed an average of 1.83±0.389 and 1.33±0.985 metastases in proper axial lymph nodes and lungs, respectively. Alone, CRC2631 or Invivomab® treatments did not significantly reduce metastasis to the lymph nodes or the lung. In contrast, the CRC2631-Invivomab® combination treatment reduced metastasis incidences in lymph nodes and the lung. CRC2631-Invivomab® averaged 1.27±1.01 proper axial lymph node metastatic incidences after 21 days compared to 1.83±0.577 in CRC2631 and 1.92±0.289 in Invivomab® alone. In the lung, CRC2631-Invivomab® showed an average of 0.727±0.786 metastases compared to 1.50±0.522 in CRC2631 and 1.75±1.06 in Invivomab® alone. Thus, CRC2631-checkpoint blockade combination treatment reduced metastatic burden.

Example 6. CRC2631 Exhibits Advantageous Properties in Combination with Chemotherapies and Androgen Receptor Antagonist Therapies Hyper activation of androgen signaling causes prostatic carcinomas (PCa), which progress into neuroendocrine prostate cancer (NEPC), a highly lethal subtype. Taxane-based chemotherapies and androgen deprivation therapy (ADT) are cornerstone treatments against prostate cancer. However, chemotherapies are non-specific and cause significant morbidity. ADT is comparatively better tolerated but it is largely ineffective, especially in patients with NEPC. Nearly all ADT treated patients eventually relapse and succumb to the disease months following treatment initiation. This underscores the need for novel targeted therapies that durably destroy prostate cancers, including NEPC.

The present disclosure is directed to an engineered *Salmonella typhimurium* bacterial strain (CRC2631) that specifically colonizes prostate tumor tissues and reduces metastasis burden at sub toxic levels in a murine model of NEPC (TRAMP). Importantly, transcriptomic and signaling pathway analyses have identified rationally selected combination treatments to achieve maximal cancer cell killing. Here it is shown that combining CRC2631 with chemotherapeutics (Birinipant or Docetaxel) or with hormone therapies (Enzalutamide) generates advantageous cell killing effects on PCa and NEPC cells.

Prostate adenocarcinomas are androgen sensitive. NEPCs commonly arise after hormonal therapy for prostate adenocarcinoma and are not androgen responsive. CRC2631's ability to target and destroy human prostate cancer cells was evaluated using a cell viability assay. Cell lines representing androgen-sensitive adenocarcinomas (LnCAP), androgen-insensitive carcinomas (PC3 and PC3M) and NEPC (NCI-H660) stages of prostate cancer were tested. CRC2631 treatment selectively targeted prostate cancer cells including NEPCs (NCI-H660) (FIG. 9A). CRC2631 did not exhibit any effect on benign prostate cells. Thus, CRC2631 specifically kills androgen-insensitive (PC3M) cells, but it is less effective against the fully differentiated NEPC (H660) cancer cells.

The transcriptional changes of human prostate cancer cells (PC3, PC3M) in response to CRC2631 (treated compared to non-treated) were examined. Both these cell lines are AR-negative, similar to NEPC cells. To identify transcriptional programs that are unique to prostate cancer (PC) cells, genes that were also differentially expressed in CRC2631-treated benign prostate cells (RWPE-1) were filtered out. Genes-pathways analyses led to the identification of the cellular Inhibitor of Apoptosis (cIAP) as a potential target. Birninapant is a safe peptidomimetic that binds to and inhibits the activity of IAPs. LnCAP (adenocarcinoma, AR sensitive), PC3M and NCI-H660 cells were treated with birinapant and CRC2631 alone or together to test a Birinapant-CRC2631 combination effect. The CRC2631-birinapant combination selectively and reproducibly killed prostate cancer (PC3M) cells and NCI-H660 (NEPC cells) with higher potency than either agent alone in vitro (FIG. 9B). Thus, CRC2631-Birninapant combination treatment has a therapeutic advantage over either treatment alone.

Docetaxel is the standard chemotherapeutic for prostate cancer. The cell killing capacity of CRC2631 was tested against PCa and NEPCs. The cell viability of prostate cells pre-treated with docetaxel followed by CRC2631 was tested. The result was that CRC2631 in combination with docetaxel (DOX) significantly reduces the viability of resistant NEPC (H660) (FIG. 9C). Thus, CRC2631-Docetaxel combination treatment has a therapeutic advantage over either treatment alone.

Furthermore, it was tested if CRC2631 would exhibit advantageous properties when in combination with the standard androgen deprivation therapy for prostate cancer (Enzalutamide). Susceptibility of PCa and NEPC cells pre-treated with enzalutamide (AZT) towards CRC2631 was tested. A cell viability assay indicated that CRC2631-enzalutamide combination advantageously killed NEPC (NCI-H660) cells (FIG. 9D).

Example 7. CRC2631 Also Targets and Restrains Pancreatic Cancer Tumors

In addition to determining the effects of CRC2631 on prostate cancer, its effects on pancreatic cancer were also examined.

First, the ability of CRC2631 to target pancreatic cancer tumors was shown. Groups (N=15) of tumor free (BL6) animals or animals carrying metastatic pancreatic cancer (B6Panc02H7) were treated intravenously with saline control (PBS) or iRFP-labeled CRC2631, with in vivo fluorescence imaging occurring 4 days after treatment to assess the CRC2631 biodistribution. CRC2631-iRFP signals were enriched in tumor-bearing B6Panc02H7 mice (FIG. 10A). Much less CRC2631 was detected in tumor-free BL6 animals (right-most animal) where signals were slightly above background (first and second animals from the left). Similarly, pancreatic cryosectioned tumor tissue obtained from tumor-bearing animals showed an enrichment of CRC2631$^{iRFP720-cat}$ fluorescence compared to tumor-free controls (FIG. 10B-FIG. 10C). Thus, CRC2631 localizes to pancreatic tumors.

Next, whether this pancreatic tumor targeted CRC2631 could reduce tumor size was determined. Tumors were harvested from PBS (control) or CRC2631$^{iRFP720-cat}$-treated animals and weighed to determine the effect of CRC2631 on tumor size. Both doses of CRC2631$^{iRFP720-cat}$ treatment caused a reduction in tumor size by weight (FIG. 10D), demonstrating that CRC2631 helps reduce tumor size in pancreatic cancer.

The effects of CRC2631 treatment on the life span of pancreatic cancer model mice were tested. B6PanC02H7 animals (N=6/group) were treated with saline (PBS), 2.5× $10^7$ CFU of CRC2631, or 5×$10^7$ CFU of CRC2631. Kaplan Meyer survival analyses were performed. No treatment-related animal lethality was observed. Instead, CRC2631-treated animals lived longer than controls (FIG. 10E). Thus, CRC2631 can increase life span in a pancreatic cancer mouse model.

The final experiment was to determine if CRC2531 induces an immune response in a pancreatic cancer mouse model. Immune response was measured as the percentage of CD69+/CD8+ cells for no treatment (NT) control B6Panc02H7 mice and CRC2631$^{iRFP720-cat}$ treated B6Panc02H7 mice. The results demonstrate that tumor-localized CRC2631$^{iRFP720-cat}$ activates anti-tumor CD8$^+$ immune cells in the spleen (FIG. 11), suggesting immune-mediated anti-cancer activity in this pancreatic cancer model.

---

SEQUENCE LISTING (6 sequences)

SEQ ID NO: 1 - DNA, 59 bp, Artificial Sequence
  Synthetic
ttagatagcgaccggcgctttaataccggggtgcggatcgtgtaggctggagctgcttc

SEQ ID NO: 2 - DNA, 59 bp, Artificial Sequence
  Synthetic
atgaaacagtatttagaactgatgcaaaaagtgctggatcatatgaatatcctccttag

SEQ ID NO: 3 - DNA, 59 bp, Artificial Sequence
  Synthetic
ctaaatcttgcgaaaaccggtgttttttacgctctgcttgtgtaggctggagctgcttc

SEQ ID NO: 4 - DNA, 59 bp, Artificial Sequence
  Synthetic
atgcaatcctggtatttactgtactgcaaacgcgggcaacatatgaatatcctccttag

SEQ ID NO: 5 - DNA, 4857399 bp, Salmonella enterica (residues 1-1,619,133 of 4,857,399)
agagattacgtctggttgcaagagatcatgacagggggaattggttgaaaataaatatatcgccagcagcacatgaacaagtttcggaatgtgatcaatttaaaaatttattgacttaggcgggcagatactttaaccaatataggaatacaagacagacaaataaaaatgacagagtacacaacatccatgaaccgcatcagcaccaccaccattaccaccatcaccattaccacaggtaacggtgcgggctgacgcgtacaggaaacacagaaaaaagcccgcacctgaacagtgcgggcttttttttcgaccagagatcacgaggtaacaaccatgcgagtgttgaagttcggcggtacatcagtggcaaatgcagaacgttttctgcgtgttgccgatattctggaaagcaatgccaggcaagggcaggtagcgaccgtactttccgcccccgcgaaaattaccaaccatctggtggcaatgattgaaaaaactatcggcggccaggatgctttgccgaatatcagcgatgcagaacgtattttttctgacctgctcgcaggacttgccagcgcgcagccgggattcccgcttgcacggttgaaaatggttgtcgaacaagaattcgctcagatcaaacatgttctgcatggtatcagcctgctgggtcagtgcccggatagcatcaacgccgcgctgatttgccgtggcgaaaaaatgtcgatcgcgattatggcgggacttctggaggcgcgtgggcatcgcgtcacggtgatcgatccggtagaaaaattgctggcggtgggccattaccttgaatctaccgttgatatcgcggaatcgactcgccgtatcgccgccagccagatcccggccgatcacatgatcctgatggcgggctttaccgccggtaatgaaaagggtgaactggtggtgctgggccgtaatggttccgactattccgccgccgtgctggccgcctgtttacgcgctgactgctgtgaaatctggactgacgtcgatggcgtgtatacctgtgacccgcgccaggtgccggacgccaggctgctgaaatcgatgtcctaccaggaagcgatggaactctcttacttcggcgccaaagtccttcaccctcgcaccattacgcccatcgcccagttccagatcccctgtctgattaaaaataccggtaatccgcaggcgccaggaacgctgatcggcgcgtccagcgacgatgataacctgccggttaaagggatctctaaccttaacaacatggcgatgtttagcgtctccggcccgggaatgaaagggatgattgggatggcggcgcgtgttttcgccgccatgtctcgcgccgggatctcggtggtgctcattacccagtcctcctctgagtacagcatcagtttctgtgtgccgcagagtgactgcgcgcgtgcccgccgtgcgatgcaggatgagttctatctggagctgaaagaggggctgctggagccgctggcggttacggagcggttggcgattatctctgttgtcggcgacggtatgcgcacgctacgcggcatttcagcgaaattcttcgccgcgctggcgcgggctaatatcaatatcgtggcgatcgctcagggatcttctgagcgttctatttctgtggtggtgaataacgacgatgccaccaccggcgtgcgggtaacgcaccagatgctgttcaataccgatcaggtgattgaagtgtttgtcattggcgtcggcggcgtcggcggcgcgctactggaacagcttaaacgtcagcaaacctggctgaagaacaagcacatcgatctacgcgtgtgcggcgtggcgaactcaaaggcgttgctaaccaatgtgcatggcctgaatctggacaactggcaggcggaactggcgcaagcgaacgcgccgttcaatctgggacgcttaattcgcctggtgaaagaatatcatctactcaatccggtgattgttgattgtacctccagtcaggcggtggccgaccagtatgccgacttcctgcgtgaagggttccatgtggtgacgccaaacaagaaagcgaacacctcgtcaatggactactaccatcagctacgtttcgccgccgcgcaatcacggcgcaaattcttgtatgacaccaacgtcggcgccggtttgccggtaatcgaaaacctgcaaaacctgctgaatgccggtgatgaactgcaaaaattttccggcattctttccgggtcgctctcttttattttcggtaaactggaagaggggatgagtctctcacaggcgaccgccctggcgcgcgagatgggctataccgaacccgatccgcgcgacgatctttccggtatggatgtggcgcgtaaactgttgatcctcgcccgcgagacgggccgcgagctggagctttccgatattgtgattgaaccggtgttgccgaacgagtttgacgcctccggcgatgtgaccgcctttatggcacatctgccgcagcttgacgacgcgtttgccgcccgtgtggcgaaagctcgtgatgaaggtaaggtattgcgctatgtgggcaatatcgaagaggatggcgtgtgccgcgtgaaaattgccgaagttgatggtaacgatccgctcttcaaagtgaaaaacggtgaaaacgcgctggcgttctacagccactattatcagcccttgccgttggtgctgcgcggctacggcgcaggcaatgatgtgacggcggcgggcgtgtttgccgatctgttacggaccctctcatggaagttaggagtttaacatggtgaaagtgtatgccccggcttccagcgcgaacatgagcgtcggtttcgacgtgttgggcgcagccgtcacacccgttgacggcacgttgctgggcgatgtggtatccgttgaagcagcggaccatttccgtctgcataacctggggcgatttgccgataaactgccgccggagccgcgtgaaaatattgtttatcagtgctgggaacgtttttgccaggcattggggaaaaccatcccggtggcgatgacgctggaaaaaaatatgccgattggttccgggttagggtccagcgcctgttccgtcgtcgccgcgctggtcgcgatgaatgagcactgcggcaaaccgttaaacgacacgcgtctgttggcgctgatgggcgagctggaaggccgtatctccggcagcatccattacgataacgtcgcgccgtgctttcttggcggtatgcagttgatgattgaagaaaacggcattattagtcagcaggtgccgggctttgatgagtggctatgggtactggcttatccgggcattaaagtttctaccgcagaagcacgggccattttgcctgcgcagtatcgccgtcaggattgcattgcgcatggacggcatctggccggttttattcacgcctgttactcgcggcagccgcagcttgccgccgcgctgatgaaagatgttattgccgaaccataccgcgcgcgtttactgccgggctttagccaggcgcggcaggcggtgtcggagatcggcgcgctggcgagcgggatttccgggtcggggccgacgctgtttgcgctatgcgataaaccggagacggcgcagcgcgtcgcggactggctgagcaaacattatctgcaaaatcaggaaggcttcgttcatatttgccggctggatacggcgggcgcacgagtagtgggataatcaatgaaactctataatctgaaagaccataatgagcaggtcagctttgcgcaggccgtcacgcaaggactgggcaaacagcagggacttttttttccgcacgatctgccggagtttagcctgacggaaattgatgagatgctcaaccaggactttgtcagccgtagcgcaaagatcctctcggcatttattggcgatgaaataccgcagcaaattctggaagagcgcgtccgcgcggcgtttgcgttcccggcaccggtagcgcaggtagaaagcgatgtcggctgcctggagctgttccatggtccgacgctggcctttaaagacttcggcgggcgttttatggcgcaaatgctgacgcatatcagcggcgacaaaccggtgacgattctgactgcaacgtcaggcgataccggcgcggcggtggctcacgcgttctatggcctggaaaatgtgcgggtcgtcattctctacccgcgcggtaagatcagtccgttgcaggaaaaactgttctgtacgctgggcggcaacattgaaaccgtggcgatcgacggcgatttcgacgcgtgccaggcgctggtgaaacaggcatttgatgacgaagaactgaaaacggcgctggggctgaattcggctaattcgattaatatcagccgcctgttggcgcaaatttgctactactttgaagccgtggcgcaactgccgcagggggcgcgtaaccaactggtgatctccgtccccagcggcaactttggcgatttgacggcagggctgctggcgaagtcgttaggcctaccggtgaaacgttttatcgccgccaccaacgtcaacgacacggtgccgcgttttctgcatgacggaaagtgggcgccgaaagcgacgcaggcgaccctgtcgaatgcgatggatgtcagccagccgaataactggccgcgcgtggaggagctattccgccgtaaaatctggcgcctgactgagctgggctatgcggcggtggatgatactacgacacagcagacgatgcgcgagctgaaagcgaaaggttatatctcggaacctcatgcggcggtagcgtatcgggcattacgcgaccagttaaaccctggcgagtatggcttgtttctcggaacggcgcatccggcgaagtttaaagagagcgtggagtccattctgggagaaacgctggccttgcctgaagcgctcgccgaacgcgccgacctgccgctgctttcacatcatctgcctgcggattttgccgccctgcgtaagctgatgatgacccgccaataaccattgcgcccggtggcgctgtcgcttaccgggcctatggggtggtgtcgatttgtaggccggataaggcgtaaccgccatccggcgatgccgttactgctcgtagcgtttaaagaccagctcgtcttgtgtggaggtttcttcatcaaagaaatacccttcacggtcaaacgcggtaagctgttccggcttcgttaagcggttttcaataataaaacggctcatcagtccgcgcgcttttttggcgtagaagcttaccaccttaaacttgccgtttttctcatcaaggaacacgggcttaatcagttcggcattcagtttcttcggcttcaccgatttaaaatattcctcggaggccagattcaccaccacccgatcgccctgcgcctcaagcgcttcgttgagcttatcggtaatgatatcgccccagaattgataaagatctttgccgcgcggattctccaggcgaatccccatctccagacgataaggctgcattaaatccagcgggcgcaatacgccatacaagccagagagcatacgcagatgttgttgagcaaaatcaaaatccgcgtcgttgaacgtttccgcctgtaggccggtataaacatcgcctttgaacgccagaatcgcctggcgtgcattatccggcgtaaaatgaggctgccagtcatgaaaacgcgtggcgttgagatccgccagtttgtcgctaattcccatcagcctggaaatttgcggcgccgaaagctggcgggcctgttgaataagctgctggctgtgatccaacagctccggctgggtatagcgggtcgtggccagcgggctttgataatcaagcgtttttgcaggtgaaatcagaatcagcatattcagtccttgcagggaattttctgcgactttagcaaaaaaacgccgcagagttgaccgatggttgcgattgtcggcttaatcgcgcgatgccgcctcccaggtatctggcgccagttgtggttcgatatccgggaagcgccgcggatcgaactgcggtcttacgcccagtttccgttgtcgcagataatcgctggcgagggtatacaccaccggtgagagcaacaaaatcgccgtcagattggtaatggccatacaggccatgatcatgtcagcgagctgccatatcagcggaaaactgataagcgtaccggcgataaccatgccaagcgtcgcaaggcgtaatagccagatagcctttgcgttatgtaaccgcagaaaaaacagattgttttcggcgtaaatatagttggcgacgatagaactgaacgcgaacagaatgacgataagcgcgacaaaactggcgccccattcaccggtcaacgaaaccattgcatgttggagaagctgaatgccttctgttgacgagtgggacgcgtgattccccgccagcaggataatcatcgcgctggcggtacagatgataatggtgtcgctgaatacgccaatcatttgcacaatcccctgcgcgacagggtgagggggatacgacgttgccgctgcggccgcattaggcgttgaccccattcccgcttcattagagaacatcccacgctgaaaaccgctggtaatagcctgggtgagcgtatatccggctgcgcctgccgcggcttcctgccagccaaatgcgcttttgactatcgaggcgataacgccaggcatttgctcaatatgccagaggcaaatgaatacgctgccggcgacccacaataacgcgatgaggggaatcagccattgcatcagacgggcgacgcctttgatgccgcgaatgataattaacagggcacagaacgccagagcaatgccggagataagcggcggaatgttgaaggcgaaatggagcgcgcgtgagacggcattcgcctgcacgctattaaaaatcaacccgtaggcgacgagcagaaagagggcgaaaaccacgcccatccagcgcattcccagcccacgcgccatataccacgccgggccgccgcggaactggcctgtcgggtcacgttctttataaagctgggcaagcgaacactcggcgaaggaggtcgccatgccaatgatggccgagacccacatccagaataccgcgccgggaccgcctgcggcgatagccagcgccacgccggccaggttaccgctgccaatccgcgccgcgaggctggtacacagagcctgaaatgacgtcaggccgcctggctgcgggctaaggctgcctttcagactgcggctaaattggcgaatataacgaaactgaatgaatccggtacgccaggtaaaccaacatcctgcgccgagcagcaggtaaatcattaccgagccccagagtatttcgttaataaaactgaaaaactcaggcattaacgtccctcttgttgatgccggcacgctttgataatcctgtataagcgtgacccatgatgtagatgaccttgtcagactaatattaacggcagtttaccataaatacggtggtatcctttaattgcgcatcaaccgtcggcagatacgcaaacagtgcacaagggcagccaggtgcatgtaggcggttgcgctgtgagtgcgtcgtgttatcatcagggtagaccggttacatcccctaacaagctgtttaaagagaaactctatcatgacggacaaattgacctcccttcgtcagttcaccaccgtagtggctgataccggagatatcgcggcaatgaaactgtatcagccgcaggatgctacaactaacccttctctcattcttaacgcagcgcaaatcccggaatatcgtaagctgattgacgatgctgtcgcctgggcgaaacagcagagcagcgaccgcgcgcagcaggttgttgacgcgaccgataagctggcggtgaatattggcctggagatcctgaagctggtgccggggcgtatttctaccgaagttgacgcgcgtctgtcttatgacactgaagcgtctatcgccaaagcaaaacgtatcattaaactctacaatgatgcgggtatcagcaacgatcgtatcctgatcaagctggcgtccacctggcagggcattcgtgcagccgaacagctggaaaaagaaggcatcaactgtaacctgacgctgctgttctccttcgcgcaggcgcgtgcgtgcgccgaagcgggcgtctacctgatctcgccgttcgtaggtcgtattcttgactggtataaagccaataccgacaagaaagactatgcgccagctgaagatccgggcgtggtttccgtaacggaaatctacgagtactacaaacagcatggttacgaaaccgtcgttatgggcgcaagcttccgtaacgtaggcgaaattctggagctggcgggctgcgaccgtctgactatcgcgccggcattgctgaaagaactggcggaaagcgaaggggcgattgagcgtaagctctctttctccggcgaagtcaaagcgcgcccggaacgcattaccgaagccgagttcctgtggcagcatcaccaggaccccatggcggttgacaaactggcggatggtatccgtaagtttgcggtagaccaggaaaaactggaaaaaatgatcggcgatctgctgtaatcattaacgcgtggccctgatatgggtcacgctacctcttctgaaacctgtctgtccttcccttcgcagtgtatcattctgtttaacgagactgtttaaacggaataatcatggataccttacgtattggcttagtttctatctccgaccgcgcttcaagcggcgtttaccaggataaaggcattcctgcgcttgaggagtggctcgcttctgcgctgaccacgcctttcgaggtccaacggcgcttaattcctgatgaacaggaaattatcgagcaaacgttgtgtgaactggtcgatgagatgagctgtcatctggtgctgaccactggcggtaccggtccggcgcgtcgcgacgtcacgccggacgcgacccttgccatcgccgaccgtgaaatgccaggttttggcgagcagatgcgccagatcagcctgcgctttgtgccgaccgccattctttcccgccaggtgggcgttatccgtaaacaggcgttaattcttaatctgcctggacagccaaaatcgatcaaagaaacgctggaaggcgtaaaagcggacgatggcagcgttagcgtgccgggcatttttgcgagcgtgccgtattgcatacagctgcttgacgggccgtatgtcgaaaccgcgccggaagtggttgccgctttccgtccaaagagcgccagacgtgagaatatgtcggactgaccggaaaatactgatagtagggttattcctcccggtgcgggaggaataaaagagatttagtgcgcctcgccgattggcagaatagtgcggccaaattgctcgtttagcacttcacccatcgccagataaatagcgctggcgccgcaaaccagaccaacccagcctgcgatatggatagttgcttcgttaccggtgatattgccgaccgccagcagagcgaacagtacggtcaggctcaggaaaacaaattgcagcgcgcgggcggctttcagcgtaccgaagaacataaacagcgtgaacacgccccacagacctaaataagcgccgagtagctgagcgtcaggcgcatccgtcagacccattttcggcatcagcaggatagcgaccagcgtcagccagaacgaaccgtaagaggtaaaggccgttaaaccaaaggtattgccttttttgtactccagcagaccggcaaaaatttgcgcgataccgccgtagaaaatccccatcgccagaataataccgtccagggcgaaaaaaccggcattgtgcaggttaagcagaatggtggtcatgccgaagcccatcaggcccagcggtgccggattagccaacttagtgttgcccataattcctcaaaatcatcataattgaatggtgaaatagtttcccagaataacgagttccgtattcggggcgcggcataataatcagggggaagaggactgtctatgatctaataagggggaaaagaaaatatttcccccagtgagggcattcacgcctgaacggctgccatcattcgtcgcaggcaggctatttgcaagaccgccggaatagtcacgcgatacgcgctgccgctcatcgctttgacgccgtttaacgccgcgccgaccgggccgccaagacctgcgccgcgcagcaatccgtggcccaggatgctcattgcggcatgggtacgcaaaatgcgggtaagctgggtggaaagcaggtgggagaccccttttgccagactgcgatctttcatgagcagcggcagcagttcttccagttcagaaactttggcgtctacggcttgcagaaattcctgcttatgcgccgcgtccatcttctgccaggtatgacgtaaaaaatgctccagcagttgctgttctatttcaaacgtcgacatgcttttatctgctttgagttttagccgttttgcgacatccagcagaatcgcgcggtactgttttccgtgtccgcgcaatttgttggcgatactgtcgccgccgtaatgctgaaactcgccggcaatgagctgccagttacggcggtgttgctccgggtgaccttccatcgctttgaacagctcgttatggctaagaacgctcgacaagcgagctttgcccttttcgttatgcgtcagcaaacgggcgaaatcggcgagttgttcttcgctacaatgctgaagaaagtctaaatcctcgtcgtgtaaataggtgacgttcattttcagtctggcttttggaatagaaataacagcgattaatcgtcgccaatgactttaagtctcgccatatcggaagaatttaccgtatggcctgagaaggtaatctttgatacgcagcgtttgttgtcgttatcgctattaatattgatccagcctgttgtctggccctctttgattgaggaagggacgttcaggctttggctggcgctacgcgcagttttaaaatagacggatgcgccgctaagttcgatgtcgccgtgatccgccgtgagttgaatgcgcttcacgatgcggcagacgggaattttcagcgtgagatcgttcgtttcatttctgggcatggcaataacacccagtattttatggtcgttcgcgtgcgcgacgctacttaacgccaggccgaaaagcaggccgacggaaatcgttaacacagatcgcatggaatttctctttgacgggttcaataagcaataccgtctatcatactctgctcatggcaacgattcagttttgtaatcttttctttttattacaatttttctgtgaatggtattcgttatttaatttatttcatgaatatttatctgtctggttttccatcgtgccctctcgtcactaaaaaattttttcatctcccccttgatgacgtgggttacgaccccatcttgtagtcaaccgcagtggtgagtctgaaaaaaaacgattcagggtagttgaaaccgcacgtttcgcccttattacagattcacaaccacatgatgaccgaatttttagtggagacgtttagatgggtaaaattattggtatcgacctgggtactaccaactcttgtgtagcgattatggatggaacgcaggcacgcgtgctggagaacgccgagggcgatcgcactacgccttctatcattgcttatacccaggatggtgaaactctggttggtcagccggctaaacgtcaggcagtgacaaacccgcaaaacaccctgtttgcgattaaacgcctgattggccgccgcttccaggacgaagaagttcaacgtgacgtttctatcatgccgtacaaaatcatcggcgccgacaacggcgacgcatggcttgatgtgaaaggtcagaaaatggcgccgccgcagatttctgccgaagtgctgaagaaaatgaagaaaacggctgaagattatctgggcgaaccggtaactgaagcggttatcaccgtaccggcttactttaacgatgcgcagcgtcaggcaaccaaagatgctggtcgtatcgcggggctggaagttaaacgtatcatcaacgaaccgactgccgcagcgctggcttacggtctggataaagaagtcggcaaccgtactatcgcggtttacgacctcggtggtggtactttcgatatctctattatcgaaatcgacgaagttgatggcgaaaaaacctttgaagttctggcaaccaacggtgatacccacctgggtggtgaagacttcgatacccgcctgatcaactacctcgttgacgagtttaagaaagatcagggcattgacctgcgtaacgatccgctggccatgcagcgcctgaaagaagccgcagaaaaagccaaaatcgagctgtcttctgcgcagcagaccgacgtgaacctgccgtacattaccgcagatgccaccggtccgaaacacatgaacatcaaagtgactcgtgcgaaactggaaagcctggttgaagatctggtgaaccgttctatcgagccgctgaaagtcgcactgcaggacgctggcctgtccgtgtctgatatcaacgacgtgatcctcgttggcggtcagacccgtatgccaatggtgcagaaaaaagtggctgagttctttggtaaagagccgcgtaaagacgttaacccggacgaagctgtggctatcggcgcagcggtacagggcggcgtgttgaccggtgatgtgaaagacgtactgctgctggacgttaccccgctgtctctgggtatcgaaacgatgggtggcgtgatgactccgcttatcaccaaaaacaccaccatcccgaccaagcacagccaggtgttctctactgcggaagacaaccagtctgcggtaaccatccatgtgctgcagggtgagcgtaagcgtgcgtctgataacaaatctctgggtcagttcaacctggatggcatcaacccggcgccgcgcggtatgccgcagatcgaagtcaccttcgatatcgatgctgacggtatcctgcacgtctccgcgaaagataaaaatagcggtaaagagcagaagatcactatcaaggcgtcttctggtctgaacgaggaagaaattcagaaaatggttcgcgatgcagaagcgaacgctgaatccgaccgtaagttcgaagagctggttcagacccgtaaccagggcgaccatctgctgcacagcacccgtaagcaggttgaagaagcaggcgataaactgccggctgatgacaaaaccgctatcgagtctgccctgaacgcgctggaaactgccctgaaaggcgaagataaagccgctatcgaagcgaaaatgcaggaactggcgcaggtttcccagaaactgatggaaatcgctcagcagcaacatgcgcagcagcaggctggctccgctgacgcttctgcaaacaacgcgaaagatgacgacgttgtcgacgctgagtttgaagaagtaaaagataaaaaataatcgccctttgaacgggtaattactggcacgggcgaagaggtttcctctccgcccgtgtatgcatgttaagggcagataaaaagagatggcgaaaagagattactacgagattttaggcgtttccaaaacagcggaagagcgtgaaatcaaaaaggcgtataagcgcctggccatgaaatatcatccggaccgcaatcagggtgataaagaggccgaagctaagtttaaagagattaaagaagcctacgaagtgctgaccgatgcgcaaaaacgcgcagcctacgatcagtatggtcacgccgcgtttgaacaaggcggtatgggcggcggatttggcggcggctttaatggcggcgctgatttcagtgatatctttggtgacgtttttggcgatatctttggcggcgggcgtggtcgccaacgtgcggcgcgtggggctgatttgcgttataacatggatctcaccctggaagaagcggtgcgtggcgtgaccaaagagatccgtattccgacgctggaggagtgcgacgtttgccacggcagcggcgcgaaagctggcacgcaaccgcaaacctgtccgacctgtcatggttctggtcaggtacagatgcgccagggattctttgctgtacagcagacctgcccacactgtcagggacgcggtacgctgatcaaagatccgtgccataaatgtcacggtcatgggcgtgttgaaaagagtaaaactctgtccgttaaaatcccggcgggcgtggataccggcgatcgtattcgtctggcaggcgagggcgaagcgggcgagcatggcgcaccggcaggcgacttgtacgttcaggtccaggtgaaacaacaccctattttcgagcgtgaaggcaataatctttattgcgaagtgccgatcaactttgcgatggcggcgctcggcggtgaaattgaagtgccgacgttagatggtcgcgtgatgctgaaagtaccgagcgaaacacaaacgggcaagctgttccgtatgcgcggcaaaggcgtgaagtccgtacgcggtggcgcgcagggcgatttgctgtgccgtgtggtagttgaaacgccggtcggtctgagcgaaaaacagaagcaattgctaaaagatcttcaggaaagttttggcggcccgacgggagagaaaaacagcccgcgttcaaaaagcttctttgacggcgtgaaaaaattctttgacgatttgactcgctaatcttttcccgttgtatttttcttcagcccgggtgtatatccgggcttttttctgcctgtacgcgcccaggcttctgttaaacgcatcgtatcctctcatttgttgatattttgtttttactgataaacaaattgatgttaatcagcagttttgtatacgcttattctttaaaaaaacgtgatgtgatgacattaatgattgcttttttagatgctgtgaattgatttatcttgagtattatctatattgctttttttagtttccggaggcagacagcgaatgggatcgaaaggtgccaacaagagctttgattataatttaatcaaaattcttgacgctgttattttgtcaggaaatgcggctatggcggcaaaaaagttaggcattacaccggctgccgtttctctggcgttaaagcgcctgcagagttattacccggaggaactgtttagcagagggaaaggcgggctcatccccacagctaaggctgtcgacattcaccaaaatttcagtcaggtgatgaaactggtggatgatacatttctctgtaatagcaaaaaagatgaagcgttccagataacgttattaggcagtgatattgttgaaagctattatctttctcagctctataacagcgatatatttgaccgtattttgataaatcatttctccgtaagaaatatgagtcgggagcatatcagcgaacttctgtttactgcgcaaggcgatctgttgattagtgccgaacctttgctggagtccggcatagagaatcaaatcattgatagttttaaatcatttgtttgtatctgcagcagtaaacacatgctgagtaccctctcacaactgtcgctacatcatttttattcttcgcgtcatgcgttatatcagccggggatgggggcttcagtgatatatcatgatagcgaattatttaaggatgatctttactatactggcaggcgtattgtcggctatcgcagtgattcgcttaacggtttgatgagcatgatcgaacgaacctcattgattgcattgattcctttgaaattagcgcttttttataaaaatcatcgtaaatatgacattaaatttattcagcctccgcccgaactggctttgaagtcagttcaggtctatgcatcctggaataaaaatagtagaaatatatcgacgattaatgagatggtaagtatgttacaaacactttcctccttccgtcgctaatacacctcatttttacgctttgatttaatatggttttaaatgatgtgctttgatttttaccctcctgacagggcgcttacactccttgtgttaattattcatttataatgatttcggagtgttaaaatgtctattcccaaccatgtgtcgacaacggaagttgtgctattggagctagagatcttactcactattatttcgattggcgcgtggggaggctttgtcagctatcttttacgcaaagataagacagaatataatagttctcatgaaagtattaaatattgcttaacgcagatcgtgatttcctgcttcaccagtttcttgttaagcgcgattgcgatcgaaaaagaatgcagtttcaacattgttctgttggcggcaggcttaggcggtgttttcgcgagtccgatcttaaagattcttgggcggcggattaaaaaaattatcgaaggtaataattcagattaattatcatttgcagtatcaggctcatccgtgagccttttacgcgtcttttttcagcctggtctaggtcactctattcttgatccagccataaataaattgttcgttattgtggtttttctcagcaacgtttaagtagtacgtgccctgactgcaattgagggctttcaccaaaacggcttccccttcctggcctcgccaggccaaataatgttcgagagcggcaagcgtccgcgggccaatattgccatccacatgaatatccgggtagcgtttaccttcgtgattaaagacgttcaaccagcgttgcagccacgcgctggggtggtaagcgcctatgttgactgccgcatcgcacagctcgaaggagactggccacgatagcgtcgagatgacgtcaaaacctggttttatccagtaatcctcttcgagaatcgcgtaggcttcagcgtgggtcagatcccgcatatcgccagcatagccatgcgctcgcgccgtggcttcggtaatgccccaatgggtggcgccgcctttatctttagggttaaatacgtaaccgccttcaagcgcaataattccatctataattggattcatcttccctttccttcgcttagtgaatatgcagatacatgagagaacctaacgttactgaaaatacggtcgtcagggcggcgatggtttgccgtacaatctgtttttttcttccctttgtttcgctatccgtcgcgataatggtgatatcactattaactttgaggccttgtcttggaatggtaataaaaagatcgttaataccaagcgctttaaggtcacgtctgattaaatagagaatctgcgttagatttgcatcattaacataatggcttcgacttccccataacgcagtggttattttttgtcgctcgataatctccagatgagcattctcgatgatgaaactgagacatttggctctcatcgcagtcattttaataacctgtgaatttgagaccgtcctcagttcatatttaccttcattgtaaatgcaattgctattaatgatataagttttcataacgtcttcctttagaaatgtacatcctggttgtctgtggtgactatattgtatgagaaatgtcttaatccaataaatgtcactggttttattgtattgtcattgtctatagcgagtgtaatcacattatttcattgtaattaaatgatatttaattacatgataaatgatatttactatgttctcaccagaacggagtaagcgggcgctgagaggtgttgttttctcttcgttagacggtgttgttaacctcatttttatgatttttatatcatctaaaaagatgatgttttgtgattagctattttttatgcctgtaacgattatggaccccgcagaacgagctgcgacaattttgaaacgtaaaaggaaatttgaaaatggctacaagcaaactgattcaaggcgatacaattactgaaactactcatgcagcgaatggttttgaccctgcaacaagcgatgataaaataagctatacttccgctcgtgttgcgaaaccggtatacaataaatataaaaattccacgactaaaccgaaggtattcggttattacaccgactggtcacagtatgacagccgtctgcaaggcaatatgtcccaaccgggccgtggttatgatttaaccaaagtttcaccgacggcttatgacaaactgatttttggctttgttggcatcaccggtttcagaaaaattgatacagaagaccgcgatgtcgtagcagaagcggcagcgctgtgcggcaaagtgaaatatgagccgaccttcctcgacccatggggcgacttccagtcttatatcaacctcggctttgatgtcagcggctgggatgtggatccgaagactgtaactcagtctaacgccaagggtctgctgggcgcgctgcgtgatatgcaggcaaaagcgaaagccgcaggtcacacgctggcgctctccatgagtatcggcggctggagcatgagtaacgggttccacgaaaccgccgcttctgactcttctcgtaaaatcttcgccaaaggcgtggtgaaactgttcaaacagttcccgatgttcagcgaagtggatattgactgggaatacccgaacaatgaaggggcgggcaacccgtttggtccggaagatggcgctaactacgcgctgctgattgccgaactgcgtaaacagctggattccgcgggtctgagcaatgtgaagatctctattgccgcttctgctgtcactactatttttgactatgcgaaagtaaaagatctgatggctgccggcctgtatggcatcaacctgatgacctatgactttttcggtacgccgtgggcggaaacgctgggccaccacaccaaccgcaaagcgctggaagagggcggctgggctgtcgaaactatcgttgatcacctgctggcagaaggtttctccgctgaccgtatcaacatcggttatgccggctatacccgtaacgctcgtcaggtagaaattgaatccctgtcgccgctgaaaggttcttacaacccaggttcaggccctactaccggttccttcgaatccggcaccagcgaatggtatgacgtcatttatagctacctggatctggaaaaccagaaaggccgtaacggtttcaacgtttacaccgaccaggtcgctgatgctgactacctgtatagcccggaatccaaactgtttttatccctggatacgccgcgtactgtcaaagcaaaaggcgaatatgcagcgaaactgggcctgggcggcgtgtttacctggactatcgatcaggacaacggcgtgctggttaacgccgtgcgtgaaggtctgggttatgaaatcgaatctgaagttatcgatatggaaccgttctactttgaaggtatcaatgtagaaaaagatgaagagcagagcgacagcgacgacgcgcagaaggtcaaccacgcgccgaaagcggcgattgaactgatggttgtaggcggatctacggtacagctgtctggcgcaggttcttctgatgaagataacgatgagttgtcctttagctggggcgtgccttctcaaatcgatgtggcagacaaaacggcagaaatcattgaggttgtggtaccggaagttagcgaaaaaacagcctttcagttcaccctgtttgtacgcgactgctacaacgaaccgtcctctcaacagcgctttgttctgacggctgtgcctgcgctatctcaggttcaaccggaaccggaagaggaagaagagattatcgttcctgtaccggacgaggaagaagataccacgccggctgaggatgatacgccagcagatgacaaaacgtcaccttacgcgcagtgggatgcttctaccgtttatggcgcaaactggggttctttcgaaatcgttagctggaaaggccataactatcaggtgaaatggtggtctatgggcaaccagcctgacctgaactgcggtgtcggcggtgcatggaccgatcttggcgcttactaatacacggtattaagccgatgtattgggcttcatgattcaagccccggtttaccggggcttttctccaccagggacagaggaagagtagaccatgaccatttccattcacgccagcgcatttgacgtcaacagctggtatcaaaaaattaccttaactttcatcaatgagagcggtaatgcggtcgatatgaaccatgccgcaatatcattcacggcttccgggcacatcgatccatggggaaatagcggcggtacgctcaaagggaacctgccgcttacgctgaatgagagttcgtatggcacgctggaaactaacaacatcatcattaataacagcgatgcattacttcttcagccgggcgaacgcgggacgctctctttcagcctcgcggcgacgcaggtgccggtaaaaatgtccgccatcaccttgacgctggcgtcatcgtcatccgaagacgcagagtctgcaaccccatccgatcaggagacgccagcgatacccgccgcagacgaacaacccgccgaacccgatgtgccggaaaaggacaatgaccttcaggaacacggccttacgcttaacgttagcgagttgaataccgcaagttggtatcaacgcgtcacctttacgctgaccaacctctacgcccaggcggtagatctcaatcagcttcaactgaattttacggccagcgcgcaccccgatccctacagtccgtttcagggaacaatgttggggaatcaggccgtgacgctggccagcgatgggggatggcccatcgagaagaataccatcaccattaatcatgacggcgcgctgatactggcggcgggggataccgccgaattacagtgctatctggccgccacgcagacgccagttgccatcagcgatttgaacgcgacgttggcccatgatcctgcccgtcagggaaaagtttgcgttcattttcctgccatgacgcagaccgtggcgctcaaaccggtgattgagctgctgtttcctgccggcgaaacccggcgctttgtcggtgagtggggcgaggttctgacaataggcgatcttagcgcaggaacgtatcggcttaccgtaccggtactggcgaatgatgagatgcaaatcgcgccagtcgagtcctcttttaccgttacgctgcaatccggcgatgccgccgcgcaggtccaggtatcctgtctgccgattgtccgttatgccagcgcgcgtctgatgattgacgcccctgcgcttggtaatgcgaaattgaccgttgagatcgccgatgctacgcaagcggatgagcgtaccgtcacgctgatcgccaaccaaccgcagttaatcacccggctactggcggggcatcattatacggtcaatctgcagcctgcgatgattaataaccgctttatatcggcacccatacagcttacggggtttatccctgctgcggcgcagattgccgaggttgctgtcgcttaccaacagtcggcgctcgacacggcgagtttcgtgacggtggatgccactatactgggcctgcccgatggcgtcgcgccgcagcgttatctgttcagcagcggtaaatatcagtactcattaatgctggagagcggcagcgatcggcagacgttggcattacgctttgcacccgggctgtatgatgttcagacggacgacattttcatcgacagtgtgccgtggcgttgtgaacaggccgggccgctacggttgttgcaaaaggtcaaccatgtggcgctggagtttctgcccggcgtgacgctacaggtaaaaggttggcctgattaccttgctcatggcggcgtgacggttaacgcgccagagacggtttctctttatcgcgatataccgtttagcgcgttgtttaaatacgatggttttgacggcggcggcgatccggttccggccgcggaggttgacgtgaacggggatggttttctggattacgcgacgttaccgatccataaaaccgttgcgctggtgcgccagatagaaaaagaagccgggcgtagcgtcatgccggtaatggtcatttataccgcgaatgccagcggcggtagcgcgctggcggatttacaggatgcgcaaaagctacgtaaccattttggtaactttattacccagtgtctggcggcgcagtcatacaaagatgagacgcatcctgtcccggccacctttgtgcttaacccggattttctcggggcactacagcaaggaccgtatggctataccgtagtacggcaaaaaaacagtgtgccggtgaatgcccaactggcggcggcgatacaagcattaccggcgatggctggctttatcgcgccttcgttgccgacgtttagcgacgatctctacggctatattcaggcggtgaactatcttgttcgtcagtttgccccggatgtggcttttggctggcagacgaatgtctgggcgacaggaacggcggactgggtgctgcgcgataccgctgatccggtagctgaagggcaggcgatcgccggatttattcatgaactgggcgtttacagcggagaatatgcgccggactttattgcgtttgataaatttgagtgtgactgtttcagtcctgatgcgcttgcccactatggctggaatgcgacatgctggcttaattacctggcgatggtcaaacaggtgacgaaagcgctgctgacgcccgccatgctgtggcaaatcccaggcggccatatgcctacagtagaagagggcgtcagtaaaatcagcgctgcgcactttgcatccggcggaaccttttttatgggtgacgcccgcattggcagcgatcctgacacgctctctttgcagctactcaatacggccttaaatagcgcgacttacggcgtcccgaccgtcggcgactttttacgtaaagataaagggtatgactggggccaaatgcaggcgctgaacctaccggactttaacgtcttttcgatcttatggggcggtggttctactatcagtattacgacaatccattctaacggtgaagacggcggctggctggcggataaaatggtagagtattatgctgcccctcgctatttcagataatatcactgcttatttgcattaatctggactattagtttgagattcgaaggcgcgttctttcgaatctcttttcctgcgccccctgacctctcattctttatacgtaatttgttattaattttctgtaatcattttgtattaagaattgtcttaatcttaaaaatattgcgtattagtgcgttgtgaatacagaaatactgcatagcgatgttatttattattaatttaagtactttttgagaggttatactgtgacgctacattgagtagacaaccgttaatgaaaaaaatgatgaacgacgcttttgctaaagataataatgagaattcattacactcttttcttttttctcagcaggctaaacctcacgcggcaattgatgccttattttcggccttgttgccatttggtcaaccgtttacgctgggtatcggcgatgagttttatttacaggcaaacgatgaacactacattgtattactggagtcaggcgttgtttctttctgtcatgatgacaaacgactccatatatcttcatcgtttgcgccatcggtcgtgggtatggttgacagctatggcgctacctataacgtccccgcgcgaccggaacactttttgctcgcagaaacggtttgtaccggtagatttgttcgcctgccggattttataaaaatcgccgatgaatgcgatttgtggcacgacgtggcccgttgtctggcttaccgtctgatggtgatgagcgcgcgcgatcgtgaattagtcggcgtcgattcttatctgaaagttcgggcgctgctgactgaaatctgggcttatccacaggcctaccgggaaagcattatcgtgttgaattttattcaacggcgtaccgggatatcgcgcagtcggaccatgaagattctgtctgaactaaaaaaaggcgggtatatccatattgataatgggcggctgacggcgctcggaaaactgccagtggcgtattaatgcactatccgcaacgatatatttacatatctcgactgaatttgcctggtatcgttaatagaatgttttactgaaggttgttatgaaagctatttttaaaaagtcaatatggctaaaggagataggccgaacgactggtgtaaagttaatataaaacaacaggttatgcctggtcctataaaaccaaatgtcgatgattgcaacttgccgttggcttgctaataattaataacatcgttatctcattataacgtaaagataaactcacgacgttgagtggctgttttattgcttctgacatttatatcagaacaagaagacactttttttcgcataagaaaaagtcgtgatattgctgtgaagaaatatcagcagccgtttcgttaaaaaatctgattacccttatttttatatttaaaaggagcttgaatgaaaaagcctgtactagcattaatggtctctgccattgcctttggcggaatgttgtccaccgcgcaagcggatactacaaccgtcactggcggtacggtaaattttgtcggacaggtcgttgacgccgcctgttctgtttccgctgactctgtcgatcagaccgtgacattaggccaggttcgcgccagtaaattaaccgaggccggtatggtggcgaatcaaaaagaagatttcaccatcaaactggaagactgcgatactcagaccagccagaatgcggcggtgatttttaatggccaacaggacgcaaaccagccggggtcgctggcgaataccgctggggcaggttcggcgacgaatgtggcattacaactttatggaccagatggccaggcgctgaatatcggtgaatcgtccagtactgttaccttgaatgatggcgaaaacgttattccgcttagcgtggattatatcgctaccggtacggcgactgccggtaatgttaccgcgacggcgacatttagcatggtttattcctgattccttatcgggatttttttctcgtctgttgggaggcgagaaaggggcgttacgcgcgtcactgcgcgtaacaaaccgacggcatcaggatattacgcagatgaaaaaaaacgtaccgattttccttcgattattgctactgctgtcggcggccggcctgtcgtttgccgcgcaggcgggaggcattgcgctgggcgcgaccagggtgatttatccgcagggaagtaagcaaacctccttgccgattattaattcttctgccagcaatgtttttttaattcagtcatgggtcgccaatgccgatggttcacgctcgacggattttatcattacgccgcctctctttgtgatccagcctaaaaaagaaaatatattacgtattatgtatgtcgggccgtcattaccgaccgatcgcgaaagcgtattttatttaaacagtaaagcgataccctctgtcgataaaaataaattgaccggcaactccctgcaaattgcgacgcaaagcgtgattaagctatttatccgcccgaaaaatctggcggaggcgccagctcatgccccgtcgacgcttcgctgccgtaacgagcgcggccagctaacgattactaacccttcgccgtactacgtttcgatggttgaactgtatagcgcggggaaaaaactgccgaatactatggtaccgccgaaaggcgcgatcactctcccggcgacgcccggccaggtatctttgcgcacggtaaacgattttggcgcaacgacgccagcacgcgtttgtccagcttcatgatgttatgcgtaatcagcttttcatgacgcgatattactccagcgtaactaaacccgtattaaccccgctggcgttggctatcgcactggcgcctgcgccggggtgggcggaaaactatttcaacccggcatttctgtctgacgacccgtctgcggtggccgacctatcgaccttttcccgtaatgcccaggcggcggggatgtatcgcgttgacgtttacctgaacaatacgtttctcgcaaccagagacattgccttccaggcggtgaaaacgacgggaaaaagcgcgcccaccgatgacagcggattacgcgcctgcctgacgcctgaaatgcttaaaaatatgggggtaaacaccggggcgtttccactgttggcgaaggcggcggcgggaagttgcccggatctcgccagtgcgataccggccgcccggacccgctttgattttgcgcagcaacgtctcgacattagcatcccgcaggcggcgatggttgccagcgccagaggctatatcccaccgaaatactgggatgaaggtattaatgcgttgctattgaattacacctttaccggcgcgaatagtcaggatcggagcccaggcggcagtgcggagaacagctattttcttggattgaatagcggccttaatctgggggcctggcggttacgcgactactccacatggaacgcgaatagcggcgatcagaatagcgacagcgactggcagcacatcagtacttatctggaacgtgatgtggtctttttgcagggagaactgacggcaggcgatagttataccccctccgcattattcgacagccttccttttcgcgggctacaactggcgtctgacgacaatatgttgccagacagcatgaagggcttcgcaccgaccattcacggcattgccagaagcaacgcgcaagtgaccattcggcaaaacggctacatcattaatcagcgctatgtgccgcccggggcatttactattaatgatctctatcctaccgccgccagcggcgatttgactgtggaagtcaaagagtccgacggttctattaatcgttataacgtgccctattccgccgtgccgattctacaacgagaagggcggctgaagtatgcggcgacggtggcggagtatcgcagcgatagtagtcaaaaagagaaggtgaaattcagtcaggcgaccttgatatgggggttaccgcatggttttacgctgtatggcggaacacaactttccagtcattatcacgcgctggcgatcggcagcggcgcaaatctgggcgactggggcgcggtgtcgctggatgtcacccaggctaccagtacgctggcggataataacacctaccaggggcaatcgctgcgtttcctgtatgccaaatcgcttgcacagtcaggaaccaatttacagcttatgggctatcgctattcaacctcgggcttttacacgttggatgataccacgtggaaacggatgagcggctatgacgatgacagtcggactgacagcgataaaagcaggccggaatgggcggattattacaacctttattacaccaggagggggaaagtacaactcgatatcaatcaacagctaggcgggttgggatcgctttttattaccggcagccagcaaagttactggcacactgatgaaaaggattctttgttgcaggtgggatacagcgatacgctggcgggtattgcatggagcgtttcttacaacaataacaaatccgcaggcgatgcggagcgcgatcaaattttcgcgctgaatatctcggtgccgctaagtcaatggctgcaacacggtgatgaggtcacgcgccatcacaatgtttacgctacctttagcaccagtacggacaaacagcataacgttacgcagaatgcgggccttagcggcacactgctggacgaaaacaatcttagttacaacatacagcaaggttatcagaatcacggtattggcgaaagcggcgccgctagcctggaatacgatggcgcgaaaggcaacgccaatattggctataacgttagcgataacggcgattaccagcaggtgaattatggcctgagtggcggcctggtggcgcacgcgcatggagtgacgctaagccagccgttaggcaataccaatattttgattgccgcgccgggcgcagccaatgtcggcgttgtcgaccagccgggtattcatacggacgcgcgtggctatgcggtggtgccgtatgcgacaacatatcgccaaaaccgtatggcgctggacgttaacgccatggcggatgatgtcgatattgatgacgcggtgactcgcgttgtgccgaccgaaggcgcgctggttctggcccgctttaaagcgcgggtcggcgcgcgtgccctggtaacgctgaatcataacggtaagcctgtaccctttggcgcaacggtgacggtgaatgatcgccatgcggaggcgattgttgacgaggccggggaggtctatctttccgggttgtcagcgcaaggcgttctgcacgttcgctgggggaacctaccggatcaacagtgcgtcgcgtcctatcatctctcttcctcccgtcagattctgagtcgacaacatgcggagtgtcattaaatgaaaatacctcttttatttgctctgctggcgggaagtgtcgtatcgcagtacgccttcgcagacgtgtgtaaaaacgttaacggcgtgccttccagtattaattacgatttaacgaccactctgacggcagaacaaaaccaggtgggaaagacggttcaactggaaaaaagccaggaagttaatgtacaggcggtgtgtcccgccggcgcgtcgacctatagccagacttatcgctcctatgtgtcgccatatccggtcgtagaaacgagcggtaactggaaatatttaaagctggacccggactaccttgaaggcggaatgcgaattgaggattcttcggcgggcgatatctatccgccaatgaacaatgtcctgatgggatatgatgaaaatgtgaaagcgggtcaaccgttttacgttcgtgactcaaatctggagtttcagctcaaaattgttaaaccgttcgtcggcacggtgaatattagtcctaagactatgtttaatgtttatgtcatgaccgccgcaggcgatccgctgacagatgtcgtgtacagcattctttatagtggaacggtgaccgtaccgcaaagctgtgaaatcaacgccggacaaacgattctggtaaatttcggcgcattatacagcggcaatttcaaccatgcaggccaaaagccggagggggtacgagcgaaaaaattcagcgtaccggtaaagtgcagcggtctggattcgcaggtcaatttaacaatgcgtcttatcgctacgccggatagccacgttccccaggctatcgcttcggataatgccgatgtcggcgtagtggtcgaaaccgatgaaggaaacgcgcttatccccaatgatgtacagagcgtcgcgccttttatcaccgatagcgccggacgcgctaacatcacattgcaggcctacccggtaagtacaacaggcgaaacgcctgcggaaggggcatttaccgcactggccagcctgcgagtggactttgactaaatgaacagatcacactgcgctctttttgccatgggactgatgctgtgtccacaaatcaatgccagcgctgacgacctcgcttataacctcgaatttaccggcactattgtggcgcaaacctgcgacatagatatttccagtctcagtcaaagtattgatttagggcagtttgcagttggcgatttcccctcgacgggaacaacgacaaaatttaagccctttaatatcaacctcaaaaattgttcccgaggaattaccggggcgaagatctggtttaccggcgaacccgatccggacaatcccgcgctactggcgataaccgacaccgggatgggaagcggaaacatgttagcaagcggggttggggtggaaattctgaatgatgatcaggataccatcagtatcaataatgccgactcggtggtctatccgttgaaagccggacgcaacacgctgtctttttatattcgctataaatcgacccggccgacggtcacgtccgggaacgcgacggcggtcatgtatttcgatatgcagtatgaatgaggagccatcgtaattatgcgtaacgatatcctgtacggcatcgggatgctgctggcggcatccggcgtccaggcgcacgatggccgggtctatgtttccggaaccatcacggacaatacgtgttcgctctctcctggctcggaaaatattaacgtggcgatgggcgcggtttctcaacggcagttttatcgcgcaggcgacggttccgcatggcaaccttttgctatcgatttacaaaactgcggcagcactgccagcggcgtaacggtcagttttagcggtgcggcggacagccgtaatacggatttattggcgcttaccgcaggggaaagcgacgcttcaggcattgggattgcgctttatgatcaaaataaaactttaatcccactggggcaagagagtgatgtggtgacgctcagtccgggtcaggcgtcggcgcatctgcaattttacgcgcgttatcttgccgatggcggcgcggtaacgcccggggacgccaatgcctccgcaaccttcattcttgcctatgaataagttctttttacgctgcgcgatatattggtgcttgcttcccatatcatgggcgcaggctggcgtggtaattggcggtactcgctttatctatcatgcgggcgccccggcattaagcgtaccggtaagtaaccgttcagaagcgtcctggttaattgatacgcatattttacctggtggccgctggccaggaaccaaaaacgaagggaatatcatgcccttcgtggtcacgccgccattatttatgctttcagcgcgccaggaaaactcaatgcgggtggtttataccggcgcaccgctacccgccgacagggaaagtctgtttaccttgagtatcgccgctattccctccggtaaaccggaagcgaaccgtgtacaaatggcgtttcgttcggctttaaaattgctctatcgccctgatggactcgccggcaatccgcagcaggcctaccggcatctgatctggtcgcttacccccgatggcgcgacggtacgcaatcctacaccctattacgttacgctctttttattacgtgctaacgagcgcgcccaggacaacgccggggtcgtggctccctttgcaacgcgtcaaacggactggtgccggcacacggttcgctgcactgtgcgctggcaaagtattaatgactatgggcgggtaatgccagcgcaaaccgtggatctgacgcgtattcattaacctatttttcaggcgtctcccgatagcgggaggctttccgaacttatcgaacgagacttttattatgtattatcacgcgttaaaactttcccgactggcgatgttgacgttggcaggcgttgccgtatccgcctcggcaatcgccgccgattctgccccgacgtcgcaaattggtccgacggcggaagcctacatcgtcagtcatccggataaagtgggagaggtcgtggcaacgtatttggccgaacatccggaatttttggtcgccgccagcgagacgttgcatcagcgtcagcagattgcgcaacaacaggcgtatgttcaactggcattacagtatcgtgctgagttgctcagtagcagcagtccttccgttgggcccaacgaggcaaaagcggcggtggtgatgttctttgattaccagtgctcgtggtgcagcaaaatggcgcctgtggtcgaaaacctgattaaggcgaacccggatacccggtttattttcaaagagtttcctattttttcctcccgctggccggtatccggactggcggccagagtcggcgaacaggtatggcttacacagggcggggcgaaatatctcgactggcataatgcgctttatgccacagggaaggtggaaggcgcgttaacggaacacgatgtctacaccctggcgcaacattatctaacgccgacgcagctggccgccgtaaaagaagcgcaaagcagcggtgcagtacatgatgcgctcctcactaaccaggcactggcgcagcatatggactttagcggcacgcctgcttttgtcgtcatgcctcagacgcaagacggtgatgtaaaacgggtgaccgtgatcccgggaagcacgactcaggatatgttgcaaatggcgattcagaaagcgaaggggtgatattcgctcagaggagaacgcacaggagtgaaagtaaaatgaagtctatgcgttgcgtcataccggtgattttactttcctttatcgttcatgaagggacagcgaaaccgaccgctcagattcattttatgggatcggttgttgaggcaggctgctggaatgacgtaggaaccttagaaattcaatgccataataaagagggagttgaacgttatattattgtcgagaatattatcacgccgatatcgtctcctcatgcaacggtaaaacgagattatttggatgaagataagcaattaacagtgctacgcattgtctatgactgaaccgcgtagcagaccgcagatggtgtcccgtcagtgtcgtgtgagaatattatgaaaaatgttctcaccttcccgggacacggtctacagactttatcttcagataaacggcgctaaaaagaaaagcacgaacaataaaaaaagagtgggaataccaatagatataattttattacatcggtgagtatgatattgaatagcttgtggcggtatgtcagcagcgtcaatgataaatctttcatcgatttttatcccctgcctggggagcgtaacgaacagttcgaaaagcccgatttgttgtaaatctcgtcgcagcagataaagaagttgcgtcaaattagcatcgctaacaaattgacttcgctctccccaaactgcgtgtgaaatcatctcccgcgtaatcagtttcttgtaggcattttcaaaaagatagcttaaacaacgcgcacgcattagcgtcacctttagcacttttttatcatgtaatgatattatttctcttaacgactcattataaataaattcgttattaatagtatattgtctcatgaattcactccgttttgatattcataaggtacgtttcacactgtcagtgtgttcactggcggtaaagtactccttacatcagtacggataagcgtagagaaccgcaaagaaataagagaatcatttatgattaaacgggataatattatgcttttttacttttttataaagtgtgccagatatttttgatgttttttataaaatagcatcatgtgtttttattttacacaggctgaaatgatatcaataaaattataatttaataacaaacagatagaggaaatgatttacttattgaaataagtgtggtgcaaggttaatctgcgccttaaatgatggtgccagattataccagccaggataacctatatgcggccaataaaaaatgctaaaaaaattgactacaatctgatcaaagtgttcgatacggttattactgaaggaaatgcaaccagggcggcgaggaaactggatgtcacgcctgcggcgatctctcaggctcttcttcgtttacaaaatctttatggcgaagagttatttatcagaacccgcaaaggattagttccgtccagcaaaggtaaatcgcttcaccaggtatttcgccaggcaattgaatctatagaaagcacactgtgcgataaaacagatgctcaggagagtaatgaactcattgttctgggaggtgatatcactgaaaattactattttccggcattgctggatactgtgttgatgaatcgatatattattaaacactatgcgattaaaaaaacaggggaatactcaccagcctccatgctgacgcatggctatgcggatgtcatcatgggaattctggaaattaagaatgagatgatcgaaagttatcttattgataatttatctgattttgtttgtgtttgtggtgaaaaaagtccattggttgggcttgaaaaaatgtctttatataatttttatgctgccagacatgctgtctatcattcagatatgttctcttctttcaccgctgatagcattgatttattcaagagcagtacgccttatgcggggcgcagggaaataggttattatagtgattcactatttggcgttatcgatattgttgaaaaaagcgatatggttgcgattttgccaggaaagattgctacttattttagagatgtgcggcgttataatataaaaatactacgtatgcctgatgaaatgatttttcgtacgttacccgtttatgcttatctggctacaaacagcacccattataaaaatgtcaaaaaactgatatcaacatttcagtcgacctttctttttagccaggaaaagcagcctgacgctttggttgaaggaagcacatccttatgcgatttgtcggtttaatatcaaattatcgtattaaataaataaccattatgaccatggtcagtaaagcgaaaaataatgccatatatttatactcttctttttttaaagaagaggggaggcagcttttgttttcattgctgataataatgttagcatctactttaatacccgttcgaggcaccgtggaaaaaaactggctcaggccaaagcctttaaggtcgcgccgcagtagatataatatctgggtcaggttggcgtcgctgataaattgacttctttccccccaaagttcattagtgagttgttttttataaataatctcttgttgtgcatgattcagcatatattccagacactttatgcgcattgcggcaatttttatcatctttcccgtttttatcttttttagctcattggtcttatcattgtaagtgtgcgtgctgttaattaaataaatagtcatgatgttatttaatgggtttaattagggtggcgataataatatgcatattaaatttatggatcaactggtgtgattgtaatagcgtcttttttccagagaaaatcgtatcgtgtcacaaaaatgatggttttttagaaaaactaaaattttatttttagtcgctctaaaaataaaatgatagtagtgttaatttttatcagtatattgatatgctttgattgatttattgttgacataaaataatttgaattatggcgcaaggcctatgccaaccataaaaaaggtataggctattggtcacaatgcattaatgctacataattgttatgcttttatagtagcgccagggaaataaaatcttcggacgataaagaatagttttagtctgggtgttattttatggatgttttattttaaattattaaaccgatttctcttgttgacgtagggttatttgctaagcaacgggctggcatgttgtagccgctcgttgcctatatcccaattaatcaggagaaacgtatgaataagaaaagttcgtcaatggttaacatgcccgcaccgcgtgagccgattaaccagaaaatcgataccaataacgcactggttttaaaccataacgccatatatgaacaacgattagcggagatcacgcaatctaatacctgtgacaaggccattgtcaccgtaaatccctacgggaccgccccgttgagtctctatctgggggtttggatggatgaagctgccgcgcttgagatcaatgttgttgatagcgaagcgacgacagaggaagtgcgttatcaatatgatgtacatccgggcgctaaccttattcctgtgtgtgggatggtatccgcggtgaataatcagattaccctacgccttgcctcgcaaattgtcgggcaatatacagtaatgacagacgcattaccgcccacggattcggctaacgtgagcctcggcttccctattattagcgtctcctgtcctgcgcagcaggcctcgctgatggaggaaggactttatttctccacttattttgatcggtataatctggcttttgatcataacgggattgtccggtggtatgtaagtcaggaaatcccttcttataattttgtcagaatggataacggccatttcctagcgacgtcacagggaataaaccattgtctgaatatgtatgaatttgacattatgggacgggtttatacggtttatcttctcgacaatgagttccatcactccattcttcccattgagaacaatctggcgattgcgccttcagaatatagcaatggacggccagacggttactcaaccgggaaagatggcgtttctattattaacttatctaccggacttgaagtcgcctattacgatatgctgtatgtgatggattattccagatcgccgcgtccttccggaagcgcgccaggtcaggacgtatcaatggatgactggctgcatatcaaccaaagctatattaatgaacccaacaatttgctgatctgttccggtcgacatcagagcgcgatttttggcgtaaatgtggattccggcgaactgcgctttattatggcgaaccatgaggattggtctgacgaattcaagcaatacttattaacccctgtcgatgatgatggtgtcccgctgtacgatcttacctcgccgggagggattgatgcggcagataagaatttctggacctgggggcagcataacattgttgaaattccaaacgatgagcctggtatcctggagtttatggtctttgataatggtaactatcgttcacgcgaagatgcgaaaagtctgttgccgctcgataacttcagccgggtggtgcagtttaaaataaacctaaatacgatgaccgtaacgcgtccgtatgagtatggtaaaacggaagtcgggaaccggggctatagcagttttgtgagcgctaagcatttattgactaatggtcacctggttattcacttcggcgcgacgacggttgatgagtttgaacataccattaccgcgcaaccaggttccagcgatcttgtcgatccggatgaagggcaacaggcgttaggtcgactggtattacaagaaatcaataaagagacgaaagaggtcttattcgaagcgatggtgacgtcgggctatttcaagaacgaagagacgaatggcacgaattatcgttatgatatttctgcatttcgggtatacaaaatgccgctgtttgcataactaagtatgttatgcggccggttatcgaccgcataacattatggcttatttgctaatatcatccacgcgcatggtgtggtcaggttgaatattgttaacctgcttcatatagttaaccaacgccggtgcggtttgtatccctatatatttgatatttttacctttagtgaaggtaaatccgccaccacctttaccgataaaggagtccagcgcgacggtatagagtttattgtcttctaccggtttgcctttgatatcaaattcaacaatacgctggcccagcggtttggtgctgtcatatttaaactggacggttttagatacgtgcagcataccgtttttcagatcggcagcgtgtgacatgatggatttcaggtccttaccgctgatttccatgctcatgacatcgttggtgaacggatacatactcagcacatcaccataggtgatattacctttaggcaattcggtacggatgccgccagcattatagaaggaagcgtcggcgccaggaacggtagccatcagggcatcggtgattaagttgccggttggcgcggattcaccgtaagaacgggtcagcacttccggagagtgcgcgaccacctcatcggtaattttcttaaccttgttatcccattcgtcaattttggcctgcgtgaccggatctggcttataagtatccgcatacatggtgatcaacttaccattgtagctgtccacttttttggtttccgggttccagtcaagcaccagtttacctaattcgatggtgtacgcatccgtggaaacgacaagggtatcgcccactttaatcggttctggcgtacctttatgcgcatggccggtaatcaggacgttaagtccatagccttccagcgatttcgccatatcaacgtcggttttcagtgcgcgtgcgacatcagcctcgcctgcgctggactgcatacccggcacgccttcgtgggcgagcagcacggtcaggtcaactttcccttttaactcttccagctgttttttcacataaggaatcggatcgcggcagtcaacgccttcacgcacgcctgcggcaatcgcttcatagaatgcggaaacgccgtgcataccgatgacgccgatcttgaatccatctttttccacgatggtatacggttctttaattaatggcgtatctgtgccgctgtaaaaaacattatccaacaataccgggaattgcaatttgctgagttgtttaaccagattctcatggccatggtcaaattcatggttaccgacagagacggcgtcgtaaggcatggtatttaaaatatcaataatagcctcgcctttggtcagcgtactgataaaaggtccggtgaaatagtcgccagcatcaaagaaaaagacatctttctctttcgcttttgcatctttgacaattttcgagatgggcgcaaagccgcctaccggacgtgtcttggatacataggggataatttctggggttacatgggcatgtaaatcgtttgtataataaattgtgatgtcacgcgcatcggctgaaaaggaaatggctgaagacaaaccaatgcacagcgacagtagggatatcgaaaactttttgttcatataaaccatccatttacgctacattaaagaaaaacaatgcctgtagtcgtgtcattcacgactacaaaccggggaaattaagtaatattcatcaagtttattaattattaaaactcgaagccgatcaggtaattcatacggtcgccgtagccgtcataccccaatttattattgaagtaacggtaagagacggaggcggtccatcgcggcataaatttccatgtaaacgttaccgcgccgttcaggccggtcgtcccaccctgttgttcggcgtaggcatcattacgatccatttcaacttcgttccagtttgaaatgacgaacttttcattaaacatatcgaagttataagccgcgacccaaccgagaacataaccgttaaagcctgtcgcctgtccatactttttagaggtataatcgttcgataagttatgaacagcgaaatagggcttaataaagcctgatgggctggttaaacccagataacctaccccgtacatcatgtttaattcatcaccgaatttattctccatcgacatatagagtttcatcattgcggtaaagttagagccttctactaccctataatgtcccagaaattgggttacatggttacggccttctaccggatggttgagcacgttcatttcataaaatgatgcaaattcgcccctgtcaaacacggcgccgaaatcggctaccgctttccacacttcgccgcgatcgacattgacaaagcctttattccagtcgccatatccgaagctaagtttaccgtatacgcgtttcaattccgctgcctggccattaaagcaagagaaaagaacacatgcggcgagtagactattaatatatttcttatttttcatgctcaactccatgaggtaaaaacacagtgaaatgttgtgtaaagaagcgaattctaaggagtgtctttttatacgtaggtgatagatgtctcaaaaatatcagcgacatataatcgtcaaatattcgtgtcagataatgttgtttattacgtgataactatttgatttatagtttatgtctctgttgtaaaagtcacaccggatagcatgaaattaatgaaacttcgaatgggaataatctctcgcaaagacaacttactgccattaaatgagggtgttaccgttcaaacagcaacatatattgacatcacaatagcggttctgacatatgggccatatttgagatctgcatcactcgttcgcgatttctttttttatagactgcttcaggcgtgttttctttagcacgaaatatatttatggtattaatattataatgagtgtgaataattttctacgataaaacgatgttaatggaagaaatataagacaaatcgaatatatatatagtgcaattaatttaggctgtattccgcagccgggtctatcggcaaatatatcgtaatcagaccgtgcgataactcaaaggagttgaaatgaaaagaacagtcgttgccagtatgatagggttggcgctatgcgctggatgcgtattatcaaccgcgcaagcggcaaccgcaaagcgtcctaacttagtcattattctggcggatgatttagggtatggcgatctcgccacctacgggcaccgcatcgttaaaacacctaacatagacaaattggcgcaggagggggtgaagtttaccgactattatgcgccagcgcctctgtgttctccttcccgcgcgggcctgttaaccggtcgtatgccgttccgtaccggaatccgttcctggataccggaaggcaaagatgttgcgctggggcgtaatgaactgactatcgccaatctgctaaaacagcagggctacgatacggcgatgatggggaaattacacctgaatgcgggcggcgatcgcaccgatcagccgcaggcgaaagacatgggctttgactatacgttggttaatccggcgggatttgtcaccgatgctacgctggataacgccaaggagcgcccgcgctatggcgtggtgcatcctacggggtggattcgtaatggccaacatattggccgcgcagataagatgagcggcgagtttgtgagctctgaagtggtgaactggctggataataagaaagacgataatccgttcttcttatatgtcgcctttaccgaagtccatagcccgctggcgtcgccgaaaaaataccttgatatgtattcgcagtacatgaccgactaccagaagcagcatccggatctgttctacggcgactgggcagacaaaccgtggcgcggcaccggcgaatattacgccaatatcagctacatggatgagcaggtcggtaaagtgctggataaaattaaggcgatgggcgaggaagataacaccatcgtcatctttaccagcgacaacggccctgtcacgcgcgaagcgcgtaaggtatacgagctgaacctggccggggaaaccgacggtctgcgcgggcgtaaagacaacctgtgggaaggtggcattcgcgtaccggcaatcatcaaatacggcaagcacattccacaggggatggtaacggacacgccggtatatggtcttgactggttgccgacgctggccaacatgatggactttaaacttccgaccgatcgtacctacgacggtcagtctttagttccgctcctgaaggacaagactttaaaacgccagaaaccgctgatcttcggtatcgatatgccgttccaggacgatccgacggatgagtgggcgatccgcgacggcgactggaagatgatcatcgatcgccagaataaacctaaatatctctataacctgaaaaccgatcgtttcgagacgctcaatcaaattggtaaacagccgcagattgagaaacagctttacggtaagttcctgaagtataaaaaggatattgataacgattcgctgatgaaagcccgtggcgataagccgacgcctgtcacctggggctaatggaataattataaaaaattaagtatgccacttagggcgatgcccacctgatccggtcactctgtgccggatcaggttcttttatttcagggaaggtaatgatgtttgggaaaagttgtcaggtcatggttaaaccgaccggatcggtgtgtaaccttgactgtaagtactgtttttatctggagaaagaaaagctctatccggatcgaaaaaaccattacaaaatgtcggaagagaccctcgaactcttcatcaggcagcagattgccgcacaggatattgatgaggtcatttttgcgtggcagggcggggaacccacattaatgggcatcccgttttatcgtaaagccgttgagtttcagcagcgctattgtggcggcaaaaccatcgtcaataccttccagaccaacggcatcctgatcaacgatgactgggcgaccttcttccgggagcatgattttctggttggcgtctctattgatggcgatgccgcgttacacgatgaatggcgagtgacgcgctccggaaagccgacgcatgaaaaagtagaaaatgcggtgcgttgtctggcgcagcacgacgtagaatttaataccctcacggtggttaaccgtaccaatatgcatcatcctgttcaggtctatcgctacctgaaaagcattggtagccgctatatgcaatttatccctttagttgaacgctgtggggaaaatgggctggcgcagccgcaggataaacatatcgcgatgacgccgtggtcggtcgatagcctgcaatttggtcagtttctgaatgcggtatttgatatctggatccgtgaggatatcggcgatatcggcatccagctatttgaacagacgctggcggcctggtgcggcctgccgccgcaggtttgcgtttttgctcccacctgcggcagcgcgtttgcgatggaaatgaacggcgatgtttataactgcgatcacttcgtatatccgcaatttaaactggggaatatccaccagaagacgctgcgtcaaatgaatcagggcgaacaaaatcgccagttcggcagcgataaacagcgttcaatggcgcaggagtgtcatcgctgtcaatggaagttcgcctgctatggcggctgtccgaaacatcgttttttaccctctgcgtcaggcgcaaccaatcataactatctgtgtgcaggttatcaggcttttttctcgcataccgcgacggcgatgagtgccatgcgaaccctgtatgaaaaaggcatctcacctgcagaaataaagtcaatatttgtttgaaggtagtattcgcagggagtgaatatgttttctcacattaatgtcgatgcttgcaaaacgccaggctgcaaaaatctggggattctggggagcccagactatctaccgcaagggaaaaatgttctctgtcgagcgtgcggttttttgttccccattatctcagccagatcgcttaatctttttcgccaggcggcgaatcaaccctggaaaggtctggtgaagtcctgtccgcattgtggcgggacgtcgctgaaaaaatatggattttccactaaaggtgaacggcgtatgtattgccgccagtgtaataaaacgttcatctcctataccgctatcaggagcgacgccagacaagagaaccttgccacgttgattggcgaaggagcgtcgctagttgaaatacgcgcggcgctggcgatagacagcacgggttttagccgcgaattacaaaaactgtcccgtcgcgctaatcaagcggaacgcgattttgtgtttcccgcgtttgatatcgctatgagcacgcgggcgtttcgtgtgaaatttaacggcggcgacagcagcttatacgtgctggtgacggcggaagaggagagcggtaaggtcgtcgcgatctcaacgaattactccgcccaaccggtggaagcggattatcaatatcattctgattacgaagaacgacttccgtccggcacgctggcgcatctggtgcagcgaaaagaggcgctgaccatgcgccgcaatgtattatttgatgtggattacggccccgccgttttatataaaaacgatccggggatgttagtaaaacccgtattacctgcttatcgacattttgagttggttcaggcgttgacggatgagcgttccctgaatgtccaacattatctcgatcacgaatgcttcattctgggcggctgtatgatggcgaattttagctatcttcgtcaggggcgctgtcatatttcgtttgtgcgtgaaagaggcgttacgccgcccaaacgcgatctccctccgcggttgtttttgagcggcggaattcgcaacaacgtctggcgtacattttccacacgggattatgcgatggcggtatgcaatctcacaggaaataaaaaggtgagtttgttacgccatgcgacgttaaatagcgcgacggcgtttattcgctatgttcacaaccatcccttcctgccgcatcttaaccggatgtctcctggcaatgttgttgccgtactggattacctaaaatttgaatataacgcttcacgtaactgaattgctaaaataaaaagtgtgatgaggtgttgttgcggtattttattcggacggcttaaaaatccagagtattaattttcgtggtccccatgaggggcgatgagattaatacactggagatttatcatgaatacgttaactacaacgtctgttgtccttcctgcgccgcgtccggcgattaatcagggtatcgatatcaataatgaaatggtgcttaaccataccgctatttatgaaaattgccttgcgcaggtcacgcaagagaatacggtagaaaatgcgctcatgttgttagacccttacggcacggcgcctttaagcgcttatgccggggtctggagtctggaaccggctgagatcatagtcacggtccaggatgcggcaaaaacggcgatgccggtagaacatctttacacccttacggcaggcgcaaatctgttgccggttctggggctggtagcggatactgaaaaccgtattgtcttttctcaggcagatacgccgcttgccgtctatacgctcatcacacagccattaccgccggtagattccgcggaggtcgtattaggttttccgattatcaacgtgacgcaacctgctaccgatgcgaacaagatggcgccagggttttattttattacgcatttcgatcgttataattacgcattagatcagaatggtctggtgcgctggtacgttactcaggattatccgtcttataattttgttcgaattgataatggccatttcctcactacttcagaagcgaaaaatacctatctggatatgtatgagttcgacatgatggggcgtcttcacacattctataatctcgataatcaatttcaccattctatctggccgtgggatagcaataccattgttgcgccctctgaatatacctcgggtcggcccgacgatttgaaaaccaatgaagacggcgtatcggttgtcgatctgactaccggactggagacggcttactacgatatggcgaaggtgctggatacgacgcgggtttcccgtccttcaggtacggcgccgggagaagacccgacggttaaagactggctgcatataaaccagagctacgtgaatgagacgaatcagttgttaattgcgtccgggcgtcatcagagcgcggtgtttggcgtcgatctgcaaacgcaagcgctacgctttattttgtcaacgcatgaagactgggacgacgcttatcagccttatcttttaaccccggtcgacagtgaaggtgtggcgctttatgactttagcaaacaggaggatatcgacgcggccgaccgtgacttttggacttggggccagcataacgtcgttgaaatcgccaataatacgccgggtatagtggagtttatggtatttgataacggtaactaccgttcgcgtgatgacagcaaaagcctgttaccgccggataactacagccgcattgtccatttcgtggtgaatatgaatgagatgaccgttatgcggccatttgaatacggcaaggagctgggcgcgcgtggctacagtagctgcgttagcgcgaaagcgatccagcagaatggcaatattgtggtgcattttgccgactgcacgtttgatgaaaatggccgcgccatctcttgccagcctggcgagagcgatattatcgatccgcaggcgggcagtgaggcgatggggctgctaattttacaggagattgcgcctacggagaaaaccgtgctttttgaagcgaccatgacgtcaggttactacaaaaacgcggaaacgaacggggaaggctatcgctacgatattaccagtttccgggtgtataaaatggatctgtacgcgtagcggtctatcatcaatgactgactgcactaaaaaagtccggcgtaagtcggacttcatttcgtaaaaaacgagctattcatcatatataatctaattttaacgatgagtcaggcgaggtaagatagtagatccgaagaattcacctgattgagagaataaaaagtgaaacatctgcaccgattttttagcagcgatgcctctgggggcatcattctcatcatcgccgctgcgctggctatgctgatggccaatatgggcgcgaccagtggatggtatcatgattttctggagacgccggttcagctacgggttggggcgcttgagatcaacaaaaacatgctgttgtggatcaacgatgcgctgatggccgtgtttttcctgttgattggcctggaagttaagcgcgaactgatgcaaggctcgttagccagtctgcgccaggccgcttttccggtgattgccgccatcggcgggatgattgtaccggcattgctctatctggcctttaactactccgatccggtcactcgcgagggctgggctattcctgccgcgacggatatcgcctttgcgctgggcgtgttggcgctgttgggcagccgggttccgctggcgctgaaaattttcctgatggcgctggcgatcatcgatgatctcggcgccatcgttattatcgcactgttttataccagcgatctttctatcgtctcgctgggcgtggcggcgttcgcgattgccgtgctggcgctgctgaacctgtgcggcgtcagacggactggggtatatattctggtcggggcagtgctgtggacggcggtactgaagtccggcgttcacgcgacgctggcaggcgtcattgtcggtttctttattccgctgaaagaaaaacacggtcgctcgccggcgaagcgtctggagcatgttctgcacccgtgggtcgcgtacctgatcctgccgctcttcgcttttgcgaatgctggcgtttctcttcagggcgtcacgattgacggtctgacctccatgctgccgttgggaattattgccggtctgctgattggtaagccgctggggattagcctgttttgctggctggcgctgcgtttcaagctggcgcatctgccacaggggaccacttatcagcaaatcatggcggtcggcattttgtgtggcattggctttacgatgtccatctttatcgccagcctggcatttggcaatgtcgatccggaacttattaactgggcgaaattgggcattttgattggttcattgctctccgcagtggtggggtatagctggttgcgcgcgcgtttgaacgcgccggcataatcagtacgaaggaaagggggagcgatgtatcgctcccttgcgacattgaacagggagagaaatgagcatgtctcatattaactacaaccatctttattatttctggcatgtctataaagaaggttctgtcgtgggtgccgcagaggcgctttttctgacgccgcaaaccattactggtcaaattaaagccctggaagagcgtttacaggggaagctatttaaacgtaagggacgcggtcttgaacccagcgaactgggcgagctggtttttcgctatgcggacaaaatgtttacgctaagccaggagatgctggatatcgtcaattaccgcaaagaatcaaacctgttgtttgatgtcggcgtcgccgatgctttatccaagcgtctggtcagcagcgttctggatgcggcggtggtggtggacgaacccatacatctgcgttgcttcgagtccacgcacgaaatgttgctcgaacagctcagccagcacaagctggatatgattatctccgactgcccgatagattccacgcagcaggaggggctattctcagtcaaaatcggcgaatgcagcgtcagtttctggtgtacgaatccgcttcctgaaaaagcgttccctgcctgcctggaagagcgacggttgctggtgccgggacggcgctcaatgctggggcgtaagttgttgaactggtttaattcacaggggttgcaggttgagatcctcggtgaatttgatgatgcggccttaatgaaggcgtttggcgcgacgcacgatgcgatttttgtggcgccgagcctttattcgctggatttttatgccgatgagtcggtaatagagattgggcgcgtggagaatgtcatggaagaatatcatgcgatttttgccgagagaatgatccagcatccggcggtgcagcgtatttgcaatgcggactactcggcattgtttaaactacagtagacgtacctaccgtaatacttccggctgcggtattaacccgcagccggaatcattctacaagttcagcaggctacggtactgcccaccttcgcggataaacaccggaattctgttcagtggcgtagcgtactgcagcgtctgccctcctgaatagctttcaccggtcgcaagatccgtccatgtttccccttctggtagccagacatcacgttcgcgcataccttcatgcatgacgggggcgatcagcaggtcaggaccaaaacaatactggtcggtgattgtccaacttgtttcctgttcggggaattcaaagaacagggggcgcatcactggcgtattgtgcttatgggtttcctccatcagcgctttgatatagggcttgagtttttctcgcaacgccaggcaacctgtcagtacctcgcatacttcctcaccgtagctccagacctcgttcggcgcacctgtagggcactgggcgataccatcccgatacggttgtgcgggtaaaatctgcggatcgcggttgccgtgcagacgcatcaccgggctaaagacgccccactggaaccagcgaatcagcaattcatggaatttcgggtcgtgaatattgccaccatgaaaaccgccgatatccgtcgtccaccacggtatccccgcgattcccatattgagtccggcagcaaactggttgcgcagcgatctaaacgaggagtgaatatcccctgaccagaccagagcgccgtacttctgactgccggcccaggcgcagcgtagcaggttgataacctggtcttcgccatcggctttcatgccgtcaaaaaaggttttagcgtacatacgtgggtagatattgcccacttccagtaccggcccggcatggtagcgatagttgtcgtagtcgtaaacgctgaactcaggttcggcttcatctaaccagaataacttcacgcctttatcgtaatagttgcgtttggctttgccccagacgtagtcgcgcgcgcccggatgagtcgcatcaaagtaagtggtattgccgaggaaatccatattgatcggcaagccacgttccgtttgtaccagccagccgttttcgcgcatctcccgatagctttcggtacggttatccaccgtcggccagacggagaccatcagctcaattcccagcgatttcagctcggcaatcatggcatcaggatcgggccagtcgcgcgcatcgaacatccagtcaccctgattcggccagtgaaagaagtcgattacgatcactgagataggcagattgcggcgcttatattcgcgggcgacctccagcagctcttcctgcgtacgataacggagtttgcactgccagaagcccatggcgtagtccggcatcatcggcggtgtgccggtagccagcgcgtaagcccggctaatttctgccggggtatcgccagccgtgatccagtagtccagctgttcgctgacctgcgcttcccattcggtaacgttttgggcaaaggttacgcgtccgactgccgggttgttccataaaaatccgtagcccagactggagagcataaacggtactgaggcctgggagttacgttgcgccagctcaagcacgcatcctttgagatccaggttggcctgttgatactgccccatgccataaattttttccccttcggtggcttcgaagcgggctttcagtgaatatttcccaccctgaatagggcggaactcgcgtccctcaaggttgagtgcgctgacgtactggccgtgagatgattcatcctcgccaatttcgccccgcaggcgccagaactcctgcaacaggggtttgtgtggatggcggtaaaaggtaacctgtcctttttgattgacgatagcgataattttgccgttggtcagcgttgcctggtggtgctcataatcaatgtggcactgactttctgcgactggctcagtcaatgcccagtcttcatttctcattaccggcagatgacggccgctgcgtacgcgcaggctgttctcgccccagggttcaatccataaatagcgatcgttttgctgccagaccagacgacgcgggtcttgttgcataaatggcatggtggtgcctcccatattcgagggtgaaggtaaagaacgttatgagttgacggtttccagatcgtggcgaatcttctcttccatcgcttcgtatttgcgaaagaaaagtagtgggatcgctgcgagcgcgaagagtagggcgggtgcccagataaaggcccagataatgccctccagacccgcagcactctgggcatggttggggacatagccaaaactgttcatgatccaggcggcgaaagcggtgccgaggccactacccatcttgatgcagaaggtactgccgaaggcgataagaatgccggtagccttaataccggtcttccaggcgccaaaatcaacggcgaagcccagcatggcaaatggcattgagcaggcgataccgctgccgatattgccgagtatccaggcggcgatgaggaaagtaatgttgtccgctgccagccacatcatgacgccgccaaacgtggcgaccagcagaccgcctacccatatccaggttttagccaggtatttgctaaagaaggggatagcgatgataaacaggatctgaatcgtcgccaggctgttaatcagcggtaccagatctttacggtcgaggttgtaggtcagataatagacaatggtcgtgttgcgctgctgtagggcaatccagaagatcagattagccagcaccatcaggatccacggccagttacctttcatcgccgcgaaactttttttcatcggcaacttaggttcatgctgtattttatccgtatccatttcacgaatgtttttaaacgcaaagagcgttagcgcgcaggatataatggcaaacgtaattgccgtataaataaaaccagcgtgatcatcaccgttacctaaaaaagcgactaacggcaaggcggtcgcgttcattaataaaaccccaatttgcccaccggtcattcgccaggaatttaaaaccagtctttctttgggagataaggtcatcaggggtaatattgcactgagtggtgtattaagtccggtaaatagaatgctggcaatcatataagatattgctgcatagatggcttttcctgtcatactgatatcaggagaccaaaatgacagcgcgctgaataccgcaaaaggcagcggtaaccataaaaaccagggacgacatttaccgtagcgtgaacgtgttttatcgatgatgatcccccatatgggggcgtctatgccatcgataatacgcgccagcagcaggataacgcctgctacggcaaggctaatgcccgcaacgtctgtgtagaaatataaaatgtacgttgaactgaagcagtacagcagattacccgccacatccaaagagccgtagctaatacgctgtagtaaagacaatgatgctgacccggaaggctgggtatcctcaatgacagaactcataatgataactccgatattggtacgatacgcccagaaaaacaacctctactttctaagcaagttttgaatattatttttatgtcgtttctgaatttaacctcagattaaaatgagtaagtaaggtgtacatgaaaagtagttaacccgacggcatcaatcaattattaaatcttacatcaggattgcgtttattagtttttgaatgagcgatgtttttatttgctaaggtggtcacagttttttcagtaatgaaataagaaaaggaaaacagtgaaagaaaataactttcaagtattacgtgactaagggaggggtagctgaaaaaataggctggtcaggaagagcgtgaacgagtgaggtcagagccagcggttgtcgagcaaaacggcagatagcaggcataaaaaaacccgctttacgcgggtttttctacaaagctgataacaagcaggcgattaagccagtttgttgatctgtgcagtcaggttagctttatgacgtgcagctttgtttttgtggatcagacctttagcagcctgacggtccacgatcggttgcatttcgttaaatgctttcagtgcagcagctttgtcgccagcttcgatagctgcgtatactttcttgatgaaagtacgcatcatagagcgacggcttgcgttgtgcttacgagccttttcagactgaacggcgcgcttcttagctgatttgatattagccaaggtccaactcccaaatgtgttctatatggacaattcaaaggccgaggaatatgcccttttagccttcttttgtcaatggatttgtgcaaataagcgccgtttaaattgcagcactcgttgcgtagtgatggcgcaggattctaccagcttgcgtgctgtgaatacagcctttccatgagaaaaattgcattaagcggcgggttttggggcggagtttgccgcatggcgatgaaaagcatcttctttatgtttcatcagggcaatcgccggttaaccttaaccgctgtacaaggtatactcttgcgattttcactgttttgagtcagacatgaagctgatacgcggcatacataatctcagtcaggccccgcatgggtgtgtgctgaccattggtaatttcgacggcgtacatcgggggcatcgcgctctactgcagggtttgcaggaagaaggacgcagacgcggtctgccggtggtggtcatgattttcgaaccgcagccgctggagctgttcgcgacggataaagcgcccgctcgcctgacgcgcctgcgtgaaaaactgcattaccttgcgcagtgcggcgtggactatgtgctgtgcgtgaaattcgatcgccgctttgccgctttgacggcgcaaacgtttatcagcgaactgctggtggagcgacttggcgtgcaatttcttgccgtcggcgatgatttccgctttggtgctagccgcgcgggcgatttcttgttattacagaaggcgggggcggagtatggttttgcggtttccagcacccaaaccttttgtgaaggcggcgtgcgtatcagtagtaccgcagtgagacaggcgctggcggaagataacctggcgcttgccgaaagtctgctgggacatccctttactatttccgggcgtgtcgttcatggcgacgagctgggacgtaccattggcttcccgacggcgaacttaccgctgcgccgtcaggtctccccggtcaaaggggtctatgcggtggaagtcaccgggcttggcgataagccgttacccggcgtagcgaacattggcactcgtccaacggtggctggcgtgcgtcaacaactggaagtgcatctgctggacgttgtaatggacctctacggtcgccatatagatgtaatactgcgtaaaaagatacgtaatgagcagcgatttgcgtcgcttgatgagctaaaagcgcaaatcgcacgcgatgagttaacggcccgcaagttttttgggctagccgggcaggtgtaaccctgacggtgtttatcaaaccgaaatacggaaccgagaatctgatgagtgactataaatcgaccctgaatttgccggaaacagggttcccgatgcgcggcgacctcgccaagcgtgaaccgggaatgctggcgcgttggaccgatgatgatctgtacggcatcattcgtgcggccaaaaaaggcaaaaaaaccttcattctgcatgatggccctccatatgcgaatggcagcattcatattggtcactcagttaacaagattctgaaagacattatcgtgaagtccaaaggactgtcgggatttgactcgccttacgtgccgggctgggactgtcacggtctgcctatcgagttgaaagtcgagcaggagttcggtaagccgggcgagaaattcactgccgctgaattccgcgccaagtgccgcgaatatgccgctacgcaggttgacggccagcgtaaagacttcattcgtctgggcgtgttgggcgactggtcgcatccgtacctgaccatggacttcaaaaccgaagccaacatcatccgcgcgctgggcagaattatcaaaaacggtcatctgcacaaaggcgctaagccggtgcactggtgcgttgactgccgttccgcgctggcggaagcggaagttgaatattacgacaaaacgtcaccgtctatcgacgtggcgttccgcgccgtcgatcaggatgcggtgaaagcgaagttcggtctgccgggcgtgagcggccctgtgtcgctggttatctggaccaccacgccgtggacactaccggctaaccgcgccatctccctggcgccggactttgattatgcgctggtgcagattgacggccaggcggtgattctggcgaaagatctggttgaaagcgtcatgcagcgtattggcgcggctgaatacaccattctcggcaccgttaaaggcgcggagctggaactgctgcgctttacccatccgtttatgggctttgacgtgccggcgatcctcggcgatcacgtcaccctggacgccggtaccggcgcggtacataccgcccctggccacggcccggatgactatgtgattggtcagaaatacggtctggaaaccgctaacccggttggcccggacggcacttacctgccaggcacatatccaacgcttgacggtgttaacgtcttcaaggcgaacgatatcgttattgaactgctgaaagaaaaaggcgcgctactgcatgtcgaaaaaatgcagcacagctatccgtgctgttggcgtcacaaaacgccgatcattttccgcgcgaccccgcagtggttcgtcagcatggataaagaagggcttcgtcaacagtccctgaaagagatcaaaggcgttcagtggatcccggactggggtcaggcgcgtattgaatcaatggtcgctaaccgtcctgactggtgtatctcacgtcagcgtacctggggcgtaccgatgtcgctgttcgtgcataaagaaacgcaggagctgctgccgattgagcgtactctggcggcgatggaagaggtggcgaaacgcgttgaagttgacggtatccaggcgtggtgggatctcgacccgaaagagatcctcggcgaagatgccgatcaatacgagaaagttccggatacgttggacgtttggtttgattccggttccaccagttactccgtggttgatgcacgtccggaattcgccggtcatgctgccgatatgtatctggaagggtctgaccagcatcgcggctggtttatgtcctccctgatgattagcgtggcgatgaaaggcaaagcgccataccgccaggtactgactcacggcttcaccgtcgatggtcaggggcgcaagatgtccaagtccatcggtaacaccgtgtcgccacaggatgtgatgaataaactgggcgcggatatcctgcgtctgtgggtggcgtctactgactataccggcgaaatggcggtctctgacgaaatcctgaaacgtgctgccgacagctatcgtcgtatccgtaataccgcgcgcttcctgctggcgaacctcaatggcttcaatccggccaccgatatggtcaaaccggaagagatggtggtgctggacaggtgggcggtgggctgcgcgaaaacggcgcagcaagagattctgaaggcatacgaagcttacgacttccatgaagtggtacagcgcctgatgcgcttctgctccgttgaaatgggttcgttctacctcgacatcatcaaagaccgccagtacaccgcgaaggccgatagcgtcgcgcgtcgtagctgccagactgcgctgtatcatatcgcagaagcgctggttcgctggatggcgccgatcatgtccttcacggctgatgaaatctggggctacctgccgggcgagcgtgaaaaatatgtcttcaccggcgaatggtacgacgggttgtttggcctggaagagaatgaagaatttaatgacgcattctgggacgatgtccgctatatcaaggaccaggtcaacaaagagctggaaaatcagaaagccaatggcatcaaatcgaacctggaagcaaaagtgacgctgaaatatgctgacgatgctaacggtacgatcaagaagctgaaactgttgggcgaagaggtcagatttatcttcattacttcccagttcgtgatttctgagcaagcggggggtattgatgatgaaaatattcagtacaatgctggtaatacgacagttcaggcagtggtaacgcgtgccgagggtgataagtgtccgcgctgctggcactacactactgatgtcggcaaggtggcggaacatgcagatatctgcggacgctgtgtcagcaacatcgccggtaatggcgaacaacgtaaatttgcctgatgagtaaaccactctgttcaacaggactacgctggctatggctggtagtagtcgtgctgattatcgatttgggcagcaaatacctgatcctccagaatttcgctctgggggatacggtagggctgttcccgtcgcttaatctgcattatgcgcgtaactacggcgcggcttttagcttcctggcggatagcggcggctggcagcgctggttctttgccgggattgcgatagggatctgcgtaattcttttggtgatgatgtatcgctcgaaagcgacgcagaagctgaataacatcgcttatgcgttaatcatcggcggcgcgctgggtaacctgttcgaccgcctgtggcacggctttgttgtcgatatgatcgatttttacgtcggcaactggcatttcgcgacgttcaaccttgccgatagcgcgatctgtatcggcgcggcgctgatagtactggaaggctttttgccgaagccgacagcgaaagaacaggcataagcgtaaataccgggtggcgcttatccggttttgtaggtctgataagcgcagcgccatcaggcaaacgtggtgccggatggcggtgaaaacgccttatccggcctacggttttatcgtcctttgtgcctccgggcaaaacacgtgagcaatttgcatgtctaaatccgtacagagcaacagcgcgatcctcgttcacttcaccctgaaactggatgatggctcaacggcggaatctacccgcaataacggcaagccagccctgttccgtcttggcgatacctcgctttccgaaggtctggagcagcagcttctggggttgaaagaaggggaaaagaaagcgttttcgctggagcctgacgccgcgtttggcgtccccagtccggacttgatccagtatttctcgcgccgtgagtttatggcggcgggcgaaccggaagtcggggcgattatgctttttaccgcaatggatggcagcgaaatgcctggcgtgattcgcgaaatcaacggcgactcgattaccgttgattttaaccatccgctggccgggcataccgttcactttgatattgaagtgctggaaatcgatccggcgctggaggcataaacatgcagatcctgttggccaacccacgcggtttttgcgccggggtagaccgcgctatcagcattgttgaaaatgcgctcgctatttacggcgcgccaatttacgttcggcacgaagtcgtgcataaccgctatgtagtggacagcctgcgcaagcgcggggcgatctttatagagcaaattagcgaagtgccggatggcgccattctgattttctccgctcatggggtttcccaggcggtgcgtaacgaggcgaaaagccgcgatcttaccgtttttgacgccacctgcccgctggtgacgaaagtccatatggaagtggcgcgcgccagccgtcgcggtgaggaatctattctcatcggccacgccgggcacccggaagtggaaggcaccatgggccagtacagcaacccggaaggggggatgtacctggtggagtcgccagaggacgtctggacgctgaatgtcaaaaatgaaggcaagctctccttcatgacgcaaaccacgctttccgtggacgatacgtccgatgtgattgatgcgctgcgtaaacgctttccgaaaatcgtcggcccgcgcaaagacgatatttgctatgccacaactaatcgtcaggaagcggtgcgggcgcttgcggagcaggctgacgtagtgctggtggtcggctcgaaaaactcttctaactctaaccggctggcggaactggcccaacggatgggaagaaccgcgtttcttatcgacgatgcggcggatatccaggaggcgtgggtgaaagaagccgcctgcgtcggcgtcaccgctggcgcttccgcgccggatattctggtgcagaatgttattgcgcgtctgcgcgagtttggcggcggcgaagctgtcacgcttgaggggcgcgaagaaaatattgttttcgaagtgccgaaagagctgcgtgtggatgttcgtgaggtcgaataagatttcacaattcagaaatctgcctgatgacgctacgttgaccagatcttaagaatttcttttgatattcaatgtgcgacaggaagaataaggcgtagtcgtcatccgttgctaatgccccacctttttgctattcatctgaaaaaccagcacaatcgttgctggttttttggttgtaatgcctacagggataagggaaatgggcaaaataaaatatggattgccaacgttactcgccatcggcttttggatggacgcaacaagcgccacggtgctggagctacctgcctgggagcgaaactataccgggactatcgcggggaaaccggtaaacgttaatatcacgcgatttggtaactctcttaatgggtattactgctatgaaccttgcaatcagcacaaggcagtgattgttctacgcggctcactccaggataaagaggtgcatcttgaagaacgcgtaaaggcgctttcgggttactggaatgcggaaatctccagcagtgagattaaaggcgaatggacgtccgcagataaaaaacgacattttcctgttgcccttatctattacaaacctaaaaactcccctgatattgtgctggtcacgaacacgaatgatgcagggggttacgacccttccaaagagattgattgcggcaatacgccggccatttcggcgataaaattataccgtgatggtaaactcatacagaccttagataccgcctcggtgggcacttgtagcccgtttatgcctcaatggggggatgtcaattttgatggctacccggatctgtcgattgtaacagagttacttgctgggccggatgctccagttcaaacatggctctatgaccccgccaaacagcgttatgttgatgcgccagcgtcttatcaggaaatcacttcaccagagatcgatgctgaacataaacagattgtcagctattggcgcggcggttgctgcagccatggcgtcaatgtgtatcgctggaaaggaaaaacgattgaactgatcgatcgcggtgaaagctactttcagcctgtgatcagtaaaggcaaaatgtataactgctacatgacaccttcctacgctgatgggcgtattatttatccgctagtacgtaaaaatggtcatttgacgccgcctcttagccttgatgggacgtgtcaatctttttggctaaccggtaatgttcgtaccgtgattcaggcagaaaaacccggcgctgagcccgaatcgcttgagattcagtggcaggaaaacaaagcatcgccagggcgtttttgcccattagttccgtttgtcgaaggtgataagctaagtccgcgtctggtgacggatgacgatgtgcctgatgcctgtatcagtcgcgctgagtatgaagatataaaacaataggtcaggagagcattaatgacagcatccctacacattattcttgataccgatccgggcattgatgacgcggctgcgattgccgctgcgctgttcgccccccagcttgatctgcaactaataaccaccgtcgcaggtaatgtttccgttgaaaaaacgacccgtaatgcgttgcagcttctgcatttctggaacagcgatatcccacttgcccagggggccgcgacaccgctgctgcgtccgttacgcgatgcggcatacgtccacggcgaatccggtatggaaggctatgattttgtcgaccatcagcgccaaccgttggcgaagcctgcgtttatcgctatccgggatgtgctgatgaacgccccggagcccatgacattagtggcgattgggccattgaccaatattgcgttgctactgatgcactatccggagtgtgcgtgtaacattcgccgtctggtgttgatgggcggttccgcagggcgcggcaattttacgcctaatgctgaatttaacattgctgtcgatccggaggccgcggcgctggtgttccgcagcggtctggagattgtgatgtgtgggctggacgttacaaatcaggcaatgctctcgccagattttctgaataaactgcccgcgctgaatcgcaccggtaagatgttgcacagcctgttcaaccattatcgcagcggtagtatgcgcactggcgtccggatgcacgatctctgcgctatcgcctggctggtgcgtccggagctttttaccctgcaatcctgttttgtggccgtagaaacgcaggggcaatataccgccggtaccacggtggtggatattgaagggcgtctggggcagcccgccaacgcgcaggtggcgctggcgctggatgtggacggttttcgtcagtgggtggctgaggtgtttgcctatgcgccgtaattacatgttggcgccataatctcatactttgccgcgatagagtctctccggcctgcccactttcccgtagctgatctccgcttcgagaaagttatttttcacgccttgttccagatagcgtcgggcagtggttttactgctgcccagaatttgcgccagagtgtctgctgtatgtactgcctgcgggtcggcgaatatttgtcgtacccggttgaaggtgttttcatcaattccccgcagtccgctattcggttctgcggtttgttctttggcctggatattaaataaggcatcaacgtgcgtctggtttgcctgctcactggaacgtaacgaactgcggtaacgggtgaaccgctccagggtatgctgcaggcgctgataatgtaccggcttaatcaggtaatcgaatacgcccatgcgtaaggcatcgctgatggtatccatatgattgtcggcggtaatgaaaataattcgccccgtgtagttggtgctgatggtatgacgaattaaatcgatccctttgccatcgggtaaaaaattatccaatagaattaactgtggttgatagaggcgtatttgcttcttcgcactttccagtttgtctgcgatgccgacgattgaaaactggggaaaaatcttgatggtgtccaccaggatttccgctagcatcggttcgtcttcaacgatgagtgtcgtaatgctatccatgttattcttctctggtaaaagggatatagagggtaaaaatggtgccaaaaggattattgttatcgacgataatgtcaccattggcctgcttgacgtagctgtgcaccaaccataatccaattccgtgatcgccgttgttgtgggtggtcactccacgctcgaaaatatgctggcggatattttcgtcaataccacatccctgatcggcaacttcaataatgacttcattaccttcgctgttgatcaggcactcaatctgtcgcgagccttcgcgattgagcagggtggcgttataggcgttgtccaataaattgccaacaatcgaaatccattcattatgcgagagcgatgacggcaggtgttcaacaaagcttgaaggatcgaaaatcagctccagccccagctcttttgcccgataatatttaccgattaatagccccgcaaggtggtggtcgcggaaattatgggaaataaaatcgagtactttctggtggctttccgactgctgctgaatcagcgccagcgcattatcgtagcgcttcaggaacagcagtccggcaatggtggaaataaggttgcgatgctcatgctgcacggcgcgcaggttatcggcgtattgccgcacctgacttaactgcaggctgagtgtattgatatcgtctttgttgcgaaagctaataacccagccctgaggctggttgtcaataatgaccgccatgcgactggcgatgactttcatttggttaaaggtgacgatctcatcttttttgtttttttgcggcgcatcgtaaaagaaggcctccggcaacacgacatggtggattgcatagccaatgagttcagactccggttggctcagattcagtaagcggcgagccgtttggttaatggcggtaatacggtgatgggagtcaatggcgatcaacccttcaaataccgactcaaataacacgctttgctgaattaatagttgtgaaagctgctgcggctccatgttaagcatctgctttttaatatgcagcgagaagcggcgggcacagtacaacagtaccagcagcagtaacgccatcgggaacagcaacgagctgatttgtaagttaagccagctctccaactgttccagagtatagccgacggaaacaataccgatgactttaccggtactgtcctgaatcggggatttaccacgtagggaagagcctaatgaacctttgcgcaccgatacgtagcttttagcgttatacagcgcgtcgtcgctatcgccgccctccatatatttgccgatctcatccgggttgacgtgatacagtcgctgacctttttcgttgccaacggtaatgtaagtcgcatccgaaaacgagcgcattgggtcaatcaacgctttgatgcgtgacaaatcatgcgcttctacggcttcaactaattctggcatagcggatatttgcattgcctgaataagcgcacgttggcccacctgataatgcaggcgttctttcgtgatatcggtcagataccaggtgattgccagcatcacgatggtggatgtaaacaggatcagtagaaatatccggttttgaaacgagtgtctggcaaaccagcgtgtaatttcccgtataaacatattggtatttaaatatttaattacggtattttcttgcattcggcatcaccggaacctgaaccagttcatacttacttttctttcagaaaaaatttggatgaaaatgggatacgacatgcgtatcccatccactattacatcgccagcacgtatttcagcatcacgcccgcggcaatggccgagccaatcacccccgccacgttcgggcccatcgcgtgcatcagcaggaagttctgcgggtctgattccagccccactttgttcgatacgcgggccgccatcggcaccgccgagacccccgccgaaccgataagcgggttgattttgttcttactgcacaggttcagcagcttcgccatcagcaccccggccgccgtcccgataccaaacgcaatcacccccagcagcagaatgcccagcgtctgcggttgcaggaacttatccgcgaccagcttcgcgcccaccgacagcccgaggaaaatggtgacgatattaatcagcccgttctgtaccgtgtcgctcagacgctccaccacgccgctttcgcgcatcaggttgccaaaacagaacatccccagcagcggcgccgcgtccggcagcagcagggccaccagcatgagcagcaccaccgggaagaggattttttcccgcttactcaccgtgcgcagctgcaccatgcggattttccgctccgtctcgctggtcagcgccttcataatcggcggctggattaacggcaccagcgccatatacgagtacgccgccaccgcgatggcccccagcagctccggcgccagcttgcccgacaggtaaatcgccgtcgggccgtccgcgccgccgataatgccgatggccgccgcctgcggcagggtgaagctgataaggccgaagtagttcagcgtcagcgccccgagcaccgtggcgaagataccgaactgcgccgccgcccccagcagcagggtgcgcgggttggccagcagcgggccgaagtcggtcatcgcgccgacgcccatgaagatgaccagcggcgcgacaccggaaccaatcgccactttgtagaacagcgccagtacgccaggcgtgtagcccatgtccaccgccaggttctccatctggccctgcaccgacggtagcgccagcgctaacgcctctttaatggcatgcacgtccggcgcgcagttcagcttcgcggcaatcaccgccagttgcccggcgtcgtggtgcgccagcaggctttccagcgcggtcagcgccatacccgcttccgggatgttggagagcagcccgccgaagccaattggcagcagcagtaacggctcgaacttcttcgcaatcgccagccacagcagcagcaggctcaccagcagcatgatggcctggcctgcgccaaggtgcatcagccccatgccctgaagcagggcgttcagactttccatttcagttctccgttacgccagcgtcatcagggtgtcgccgacggagaccgcgtccccggacttcaccgcgataccgcgtaccgtcccggcctgcgcggcgcggatttcggtttccatcttcatggcttccagaatcagcagcacgtcgccttcggccaccgtctggccctcggtggcaatcaccttccagatattccccgccagcggcgcggtgaccggggtgccggcgcctgccggggcggcagcctgaaccggtgcggaagaggccgccggaacagccgcagtgagctggctgatatcgccgccgtcgctgaccttcaccacaaaggctttgccttccacttccacggtgtagataccggaggcggcaggcttctctgcttttgccaccggctgcgcggcttccgcctgcggcagtggctcaaacgccgccgggttattgcggttctcaaggaatttgaggccgatttgcgggaacagcgccacggtgagcacgtcgtcgatggcgtttcccgccagagtaatccccttctcctgcgcctggcgcctgacgtccgcttccagttcagccagttccggtttgagtaaatccgccggacggcaggtcaccggggcgcccccttccagcacgcgggcctgtaacgcggcgttcaccggcaccggggtgtggccgtattcgcctttcagaatgcccgccgtttctttggcaatggttttgtagcgctcgccggtcaggacgttgagcaccgcctgggtgccgacaatctgcgaggttggggtcaccagcgggataaagccgaggtcctcgcgcacgcgggggatttccgccagcacctggtcgagtttgtccgccgcgttctgctgcttcagctggctttcgaggttggtgagcattccgcccggtacctgggccaccagaatacggctgtcgtagcccttcagctggccttcaaaggcgtgatactttttgcgcacctcgcggaagtacgcggcgatattttccagcttcaggatatccagcccggtgtcgtgttccgtgccggcaagcgttgccaccagcgcttcggtggccgggtggccgtaggtggcgctcatggaggaaatcgccgtgtccacgccgtcgacgcccgcctcgatagccttcagcagggccatctccgccatcccggtggtggcgtgacagtgcaggtgcaggcgcacctcaaaacgttttttgatttcgctgaccagctcatacgccgccatcggtgtgagaatgccggacatatccttgatggcaatcgagtcaacgccggtttccagcagttgctccgttaaatccagccaggtctgcagggtgtgcgccgggctggtggtgtaactcagggtcccctgggcgtgcgcgccgtggctgcgcaccgcctgtaatgcggctttcatattgcgcgggtcgttcatggcatcgaagacgcggaacacatccatgccgtttttcaccgcgcgttcgacgaagcgctccaccacgtcatcggcgtagtggcggtagccgagcaggttctggccgcgcagcaacatctgcagcggggttttgggcatggcttttttgagttcgcgcaggcgcagccacgggtcttcgccgagaaagcggatacaggcgtcaaaggtggcgccgccccagcactccagcgacccgtagcccacgtcatcgagcgcggcggcaatcggcagcatgtcatcaaggcgcaggcgggtggcgaacagagactggtgggcgtcacgcaggacgacgtcggtaatggcaatggtcatggatccctccgggaaattaaacgtggtggcggtgatggtgaatggcggcggcaatcaccggctttaagcgggtgaagtcgtccacgacgggaacggcgcgcggtgcgggcgcggcgacgggttccgggaagaagcgagtaatcacggcagacatgccgcgaatggcaaagatgagcaggaacagaaagctcagtacgaaccccatccctaaaaacatcagggtgaaaccttcacccagtagtacagcttcgttcatgaatcattttccataatgagaggcacgacggtggccttgacgacaaccttcctggtgaatccggctaaggagtagagtggatttcccttggccacctctggctttggcctctacttttctccaggtcgtttgctgccaagacaccgccgtgcgtttttttacaccatcatgctgaacacgatgctagcgataaccagcacaataccgccgcccagacgagaggaaatttgtgcatatgaaatgaggttcatacggttacaggcggagagcacttccagatcgccggagccgccgcggttggccatacaaagacccgcagtaatggatgattcaatcgggtagaagccaatcaaccagcccccgatagctgcgccaacgactgcgccgaccacaatgattgcggcgataactacgttcgcgaacgtcagggcatcgatgatctcttgcagatcggtgtagcaaacacccacacctaccatcagcacccacagtagctgtttggagaagaagtcagaaagacgtttcgccccggctttaatctccggtgagcaaagacctgatgcgttcagcgcagcaacaatcaggaccatccaggcgaagtagtgaatagagacgccgccgatgcttggcagaattttcttggcaacaacataggccagcaggaagcaggtggtggatagcaccatgccaaccgccgtttcacgatgggtaatctgaccggccttttcatcatcttcggttttgaaggaagccttacgaaccaactcgccttcaccgctaagccaggtgtattttttgcctatcatatcgaggagggcggcgaaaataatggcgaagatattcgcaatggtcagaatagcaatagccgttgagtaatactcttcgcgagaacgtccggtaaccgagtgataaatttcagacagaggcacggcgcccgcgccgttaccaccgcccataatcggcagaacgtacagcatcatgatacggtcgaccgggataccgaagcacagaccaatgacgataccgaaaagggacgcgccgacaatcccggcgaggatggttgggatatagcccagcagtgattttaatagcagcttacggtttaccgacaggatcgcgcctgtgatcaacactgcgataaacaggttaaggaagttgcttttatccattacgttgctgatcgcatcaatttctttctgcgtaaatatgccagcatagacaaaataagctgcaaccagaaatatcataaccggtgcgccgccaatatatttattgaagatcggtaaacgtttgccgatttcaccaaaaatggcccccatcacaaacataagggcaaaaccacctactaagtcagtcggtatagcattataaaaatgagaaagtaataaagtaattaatgcaaaggcataaagcggtagcggcataccaaagattttgaatctgagtaaatcgctagccccctttttctccgtcgccgaagcctgggtcatgttggtcataaacattttcctgtgtattgatgggtaacaagacccgcgcatactaataaattcaatgaaccatgagatgtgactatcttcactgaatggttgtgtttttaattaatttaattatttttattaactctggttaattaaggaaataaaaaccataaagcttataaaagcaagggggaaagtgtgatgtctattccagacgagtaatacaaacgctggcgaaatatgcgacgttatttgctgacggatgcagaatagagtgaatctaatatttaaacgcatttatttgcaaaaggatgtattgcgtcgcgagtcggtcgccatgtttctggagggcgtgggactcgccctggaagacgattgtgaaatcgcggtatgcgcatattggcagggtgagatagtcgggtgcggttctctggccgggagcgtactgaaatgcatcgccgtttccccggttttacaaggggaagggctcagcctcaaactgctgaccgagctgcttacattggcctacgagttaaaccgcagcgagcttttcctgttcactaagccgcaaaatcggttgctgttttctggcgcggggttttggcccattgcgcaggcaggtgagctggcggtgttaatggagaacagcagtgaacggttagcgcgcttttgtcgccaactggcgctttatcgtcaaccgggaaaaacgatcggcgccatcgtcatgaacgccaatccgtttacattgggccaccgttatctggtggagcaagcggctgcggcctgtgactggttgcatctgtttgtagtcaaagaagatgcttcatttttttcctataccgaccgttgggcgctgatcgaacaaggaatcgcgggcattgacaacgtcacgttgcattccggctccgcttatatgatctcgcgtgcgacgtttcccggctatttcctcaaagaaaaaggggttgtggacgactgccattgccagatcgatctgcaactcttccgtgaacatctggctccagcgctggggattacccatcgttttgtcggcagtgaaccgttttgtcctctgacctgtgcctataaccagcgaatgcacgacattttgcacgatccgaagcgtagcggcccggttattgaggtcgtcgagctggcgcgggtggagaaaaacggcgcggctatttccgcctctcgcgtcagaaaactgtatagcgaacgtaattggtcggcaataagcgcgctggtgcctgctggcaccctggcatatctgcagcggcatgccgccagacacactgaaaccatatgacgtaacaccgttaacaaggaacataactaatgaaaatcattaaagatgccctggcaggcacgctggaatccagcgatgtgatgatcaggattggtccatccagcgagccaggaattcggctggagctagagagtctggtgaagcagcagtttggcgcggcgattgagcaggtggtgcgcgaaacgctggcgaagctgggcgttgaacgcgcgctggttagcgtcgatgacaaaggcgcgctggagtgcattttacgcgcccgagtgcaggcggcggcgttacgcgctgcagaacaaacggaaattcaatggagtgcgttatgagaccacgtcgcagtatgttgtttatccccggcgcaaatgcggccatgttgagcacctcgtttgtctacggtgcggacgcggtgatgttcgacttagaagacgccgtagcgttacgtgagaaagataccgcccgtcttttagtccatcacgcgcttcaacatccgttctatcaggatgttgaaaaagtggtgcgcattaatccactgaacacgccgtttggtctggccgatcttgaagccgtcgtgcgtggtggcgcggatatcgtgcgtctgccgaaaaccgacagcaaaaacgatgtgctggagctggaagcgcaggtcgaacggatcgaacgtgaatgtggacgcgaggtcggcagtaccaggctgatggcggcgatcgaatcagcgaaaggcgtggtcaatgccgtcgacatcgccacctccagcccgcgcatggtggcaattgcgctggcggcatttgattacgtgatggatatgggcaccagccggggcgatggcaccgagctgttctacgcccgctgcgcagtgctgcatgcggcgcgcgttgcgggtattgccgcctatgatgtcgtttggtcggatatcaataatgaagaaggcttcctgaaggaagtgcagttggcgaaagggcttggttttaacggtaagtccttagtgaacccacgtcagattgagctgttacatcaggcttattctccgacacgtaaagaagttgagcatgcgtatgaggtgattgccgccgctgaagaggctgagtctcgcggtctgggcgtcgtttcactcaacggcaaaatgattgacggcccgattatcgaccacgcgcgcaaagtggtggcgctgtcggcttccggtattcgtgattaaggaaggaaccatgaaagagactgtaaccatgctcaaccagcaatatgtcgtaccggaaggattacagccctaccagggggtaacagcgaacagcccgtggcttgccagtgaaacggaaaagcgtcggcgtaaaatttgtgactcgcttgaagaggctatccgtcgttccgggcttaaaaatggcatgacgatatccttccaccatgcgtttcgtggtggcgacaaagtcgtcaatatggtgatggcgaagctggcggaaatgggattccgcgatctgacgcttgcctccagctcattaattgatgcccactggccgcttatcgaacacattaaaaatggcgtggtgcggcagatttacacctccgggctgcgcggcaagttaggggaagagatctccgctggcctgatggaaaacccggtacagatccactctcacggcggccgcgtaaagctgattcagagcggtgagctgaatattgatgtcgctttcctcggcgtgccgtgctgcgatgaatttggtaatgctaacggctttagcggcaagtcacgctgcggctctttggggtatgcgcaggttgatgcgcagtacgctaaatgtgtggtgctcctgactgaagagtgggtcgaattccccaattatccggccagtatcgcgcaggatcaggttgatttgatcgtacaggtggacgaagtaggggatccggaaaaaatcaccgcgggtgcgattcgtctgtccagcaacccgcgtgaactgttgatcgcccggcaggcggccaatgtgatcgaacactcaggttatttttgtgatggtttctcgctgcaaaccggcaccggtggcgcttctctggcggtcacccgtttcctggaagacaaaatgcgtcgccacaacattacggcgagttttggcctgggtgggatcaccggcaccatggtggatctgcatgagaaagggttgatcaaagcgctgctggatacgcaatcattcgatggcgatgcagcccgttcgctggcgcagaacccgcatcatattgaaatttcgaccaatcaatacgctaaccccgcctctaaaggcgcggcatgcgaacgcctgaacgtggtgatgctgagcgcgctggaaattgacgtgaattttaacgttaacgtgatgaccggttcaaacggcgtactgcgtggcgcatcgggcggccatagcgatacggcagcaggggccgatctcaccattattaccgcaccgctggtccgtggccgaatcccatgcgtggtggaaaaagtgctgactaccgtcacgcctggggcaagtgttgatgtgctggttaccgaccatggtattgcggtgaaccccgcgcgtcaggatctgcttgataacctgcgtgctgcgggcgtggcgctgatgaccatcgaacaactgcaacagcgcgctgagcaactgaccggtaaaccgcagccgattgagtttaccgatcgggtggtggctgtggtgcgttatcgcgacggttcagtgattgacgtgattcgccaggttaaaggctgatgaagggcacagacctgttgtacctgggccaggcagttacgctggaggagatgctacaagcgcgcgataaacgtgccgccaggcagcgtcaggcgttgaactgctatcggctaccgttgatttccctcacgctggttgcaccgggcgccgttaaaaactcagcggtctggcggcgtgtcgccgattacgcaattgccgaaatactggcgctttgcgaacagatggagtgggtcaacgtctgggaaatgcaggtaaatgaacgcagcggcccggaatggatggcagcggtctgtgcgccggcaatggcgttgaaacagcacatgtcgacactggagatgagccatccgttagggcggctttgggacatcgacattattgatagcgacggtaagtcgctatcacgccgtgaactcgggcatcctgcccggccatgtttgatatgccagcaggatgctcatctctgtgcccggggcaagcatcacacccttgaccttttgttggatgaaattgcacgaaggattgaatgctatgaacgtgagcgttgtgactgaacggcgtacgccagcgtactcatcgctggcggctggcgaacttaatgggttggttgcaagagcgctgctgacggaagccaggctgacaccaaaacccggtctggtcgatattcgtaattcgggagcgcatagggatatggatctggcggcatttgaacgtagcactaccgccattgctccgtggatggaaaagttttttatcatgggcaacaacacggcggcgctggcggcagaaaatgtcctggtgatgctgcgtccgctggggatggcctgtgagaacgatatgctacaggcgaccaatggtgtgaatacccatcgcggggcgattttcgcttttggcctgctgagcgcagcgattggccgacttctcgcgcggggagaaccgttggagcaaaatcgtatctgcgaccaggttgcccgcctgagtcggaatattgttgcccacgagctctcagcaaaaaaagcgggaaaactgacaaagagtgaaacccatttccagtgttatggcctgtcgggcgcgcggggagaagcggaaagcggttttcgaaccgtcagaacgcaggctttgccggtgtttaaccgggtcgtgcaggagcatgacgatacccatcttgccctactgcaaacattgttgcatctgatggcgtggaatgatgataccaatctggtgtcacggggaggcctggaagggctttactacgtgcagcagcaggcacaaaaattgttgtggcaagggggcgtattggttgaggggggcattgaagcgatgcagtccctcgatgatgaactcatcctgcgtaacttaagccctggcggtagcgcggatttactggcagtgacctggtttttaagtcattttcctgccggttccctctatcctgagtaagtttctcttctttcattctctccagcaatgattcatcctgcgggatgaatcatgtcttttactgatatcgctccctgtttatcattaatttctaattatcggcgattttagatggcggcctccgggcgcgctggttactctgaaaacggtttacgcaatttttacaaaagagaatagctatgcatgaagcacaaatccgcgtcgccattgccggcgccggtggccgcatgggacggcagttaatccaggccgccatggcgatggaaggtgttcagctgggtgccgcgctggagcgcgaaggctcttccttgctgggcagcgatgctggcgaactggcaggggcgggaaagtccggcgtgatcgttcaaagcagccttgaggcggtaaaagatgattttgacgttttcatcgattttacccgtccggaaggcacgttgacgcatctggcgttttgccgccagcatggtaaagggatggtgattggtactaccggctttgacgacgccggtaaacaagccattcgcgaggcgtcacaagagattgcgatcgttttcgccgcaaactttagcgtcggcgttaacgtcatgctcaagctgctggagaaagccgcgaaggtaatgggcgactatagcgatattgaaattattgaagcgcaccaccgccataaagtggatgcaccgtcgggtacggcgctggcaatgggcgaggcaatcgccggggcgctggataaaaatctgaaggactgcgcggtctactcgcgtgaaggttataccggcgagcgcgtagcgggcacgattggctttgcgaccgttcgggcgggcgacatcgtcggcgaacataccgcgatgtttgccgatattggcgagcgcgtagagattacgcataaagcttccagccgcatgacgtttgcaaatggcgcgttgcgatcggcgttatggctaaaaacgaagaaaaatgggctatttgacatgcgggatgtgctggggctggatgtattatagcgactaaataccttcgtgatgtggttgtggtaatcaagattaattgattacaaagggcaatatattattgcccttttgtttttgccccccggttattcggtcagataaataacgcctttcaccattcatgtttcgacagtttcttcgcccacggcatgttctgccgttgttttcgcgttaagaatagtccgtttaaagacatccgggccaacggcatccatttgcgtgacgtaattgccattacgataaatgcggttaattggcccttcagacgcatcggtacgggtcattacgttcaacgggaaaaaattactgcctgaactgacgttagtcatattcagccgcagcgccttaccgtatgcaaaaggcacctcgaccagactgataagactgatatccatcggagggggagtgctgttcctcgggggggcgttttatctcttttgcttcaataggttggcttttttatgctgtagtgaggctggttgtggtccaatcgtatgtgcctgtcttaaagaaaaagaagctggatctttatatcgcgattgtaattcttattacattgtcttaatttgctgttttttgttgattttatgatgcatttgatttgttttttatatttttaatatattgatttttaaaatttttttgtcgttaactttcttgattttgaatttttatgcatttaatggcattgatggctattaagtgagtttttatcgttgttttttgttgttttaatgtcaaatttgaccatttggtccactttttatcatgccagccagttttttgcgaactcaaggaagcgcaagcgttttctatcgtaacttagttgatctttttgcctcttaaacagaataacttccttataatgtgcaaaataacataaaaaacaccctctttaagttgacttttatccggcttaacttcagaatgccgccgtttgccagaaatccacgggtaagcaaatttgcattgcttcatactgactgaatgaattaatatgcaaataaagtgagtgaatattctctggagggtgttttgattaagtcagcgctattggttctggaagacggaacccagtttcacggtcgggccattggggcaacgggttcggcggttggggaagtcgttttcaatacttcaatgaccggttatcaagaaatcctcactgatccttcctattcccgccaaatcgtcactcttacttatccccatattggtaatgtcggcaccaataaagccgatgaagaatcctctcaggttcatgcgcaaggtttagtgattcgcgatctgccgttgattgccagcaacttccgtaacaccgaagacctctcttcttacctcaaacggcataacattgtggcgattgctgatatcgatacccgcaagctgacccgactgctgcgtgagaaaggcgcacagaacggctgcatcattgcaggcgatagcccggatgcgaagctggcgctggaaaaagcgaaagcatttcctggacttaacggtatggatctggcgaaagaagtgaccacggcggaaacttaccgctggacgcagggtagctggacgctgaaagacggtttaccggaagcgaaatctgaggatgacctgccgttccatgtggtggcctatgatttcggcgcgaagcgcaacatcctgcgtatgctggtggatcgcggctgccgcctgacggtggtgccagcgcaaacctctgctgaagaggtgctgaaaatgaatccggacggcatcttcctgtcaaacggccctggcgacccggctccgtgcgactacgcgattactgctatccagaaattcctcgaaaccgacattccgctatttggcatctgcctcggtcatcagctactggcgctggcgagcggtgcgaagaccgttaagatgaagttcggccatcacggcggcaaccatccggtaaaagatatggacagaaacgtggtaatgatcaccgcgcagaaccacggctttgcggtggatgaagactcgctgcccgccaacctgcgcgtgacccacaagtcgctgttcgacggcaccctgcaagggattcaccgtaccgacaaaccggcgttcagcttccagggccacccggaggcgagccccggcccgcacgatgcggcgccgctgttcgaccactttatcgagcttattgagcaataccgtcagtccgcgaaataatcaggagtaataagagccatgccaaaacgtacagatataaaaagcatcctgattctgggcgcgggcccgattgttatcggtcaggcgtgtgagtttgactactccggcgctcaggcgtgtaaagccctgcgcgaagagggctatcgcgtcattctggtgaactccaacccggccaccatcatgaccgacccggaaatggccgatgccacctacatcgagccgattcactgggaagtggtgcgcaaaatcattgaaaaagagcgtccggatgcggtgctgccgaccatgggcggccagaccgcgctgaactgcgcgctggagctggagcggcagggcgtgctggaagagttcggcgtcaccatgattggtgcgaccgccgacgccattgataaagccgaagaccgtcgtcgcttcgatatcgcgatgaagaaaattggtctcgacaccgcgcgttccggtatcgcgcacactatggaagaagcgctggcggttgccgctgacgtgggcttcccgtgcatcatccggcctagctttaccatgggcggcaccggcggcggtatcgcttacaaccgtgaagagttcgaagaaatctgcgaacgcggtctggacctctcgccaaccaacgagctgctgattgatgaatcgctgatcggctggaaagagtacgagatggaagtggtgcgtgataaaaacgacaactgcatcatcgtctgctctatcgaaaacttcgatgcgatgggtatccacaccggtgactccatcaccgtggccccggcacagacgctgaccgacaaagaataccaaatcatgcgtaacgcctcgatggcggtactgcgtgaaatcggcgtcgaaaccggcggttctaacgtccagttcgcagtgaacccgaaaaacggccgtctgatcgttatcgaaatgaacccgcgcgtatcccgctcctcggcgctggcgtcgaaagccaccggtttcccgattgccaaagtggccgccaaactggcggtaggttacacccttgacgaactgatgaacgacatcaccggcgggcgcactccggcctccttcgagccgtccatcgactatgtggttactaaaattccgcgctttaactttgagaaattcgccggtgccaacgaccgtctgaccacccagatgaaatcggtcggagaagtgatggcgattggccgcacgcagcaggaatccctgcaaaaagcgctgcgcggcctggaagtcggcgccaccggttttgacccgaaagtgagcctcgacgacccggaagcgctgaccaaaatccgccgcgagctgaaagacgcgggcgcagatcgtatctggtacatcgccgatgctttccgcgcaggcctctccgtcgatggcgtctttaacctgaccaacatcgaccgctggttcctggtgcaaattgaagagctggtgcgtctggaagagaaagtggctgaagtcgggattactggcctcaacgccgacttcctgcgtcagctcaagcgtaaaggttttgccgatgcgcgtctggcaaaattggcgggcgtgcgcgaggcggaaatccgcaaactgcgcgaccagtatgacctgcacccggtctacaagcgtgtggatacctgcgcggcggaattcgccaccgacaccgcctatatgtactccacttatgaagatgagtgcgaagcgaacccgtccattgaccgcgataaaatcatggtcctcggcggcggcccgaaccgtatcggccagggtatcgaatttgactactgctgcgtacacgcctcgctggcgctgcgcgaagacggttacgagaccattatggtcaactgtaacccggaaaccgtctccaccgactacgacacttccgaccgtctgtacttcgagccggtcacgctggaagacgtgctggaaatcgtgcgcatcgagaagccgaaaggcgttatcgtgcagtacggcggccagacgccgctgaagctggcgcgcgcgctggaagcggcaggtgtgccggtaatcggcaccagcccggacgccatcgaccgcgcggaagaccgcgagcgcttccagcacgcggttgaccgtctgaagctgaagcaaccggccaacgccaccgtcaccgccattgaacaggctgtcgaaaaagcgaaagagatcggctacccgctggtggtacgtccttcttacgtgctgggcggtcgggcgatggaaattgtctatgacgaagccgacctgcgtcgctacttccagacggcggtcagcgtctctaacgatgcgccggtgctgctggaccgcttccttgatgacgcggttgaagtggacgtggacgctatctgcgacggcgaaatggtgctgattggcggcattatggagcacattgagcaggcgggcgtacactccggcgactccgcctgttccctgccggcctacacgctgagccaggaaattcaggacgtgatgcgccagcaggtgcagaagctggccttcgagttgcaggtgcgcggcctgatgaacgtgcagtttgcggtcaaggacaacgaagtctacctgattgaagtcaacccgcgtgcggcgcgtaccgtaccgttcgtctccaaagccaccggcgttccgctggcgaaagtggcggcgcgcgtgatggccggcaaatcgctgaccgagcagggcgtgacccaagaaattatcccgccgtactactcggtgaaagaagtggtgctgccgttcaacaaattccccggcgttgacccgctgttagggccagaaatgcgctccaccggggaagtgatgggcgtgggccgtaccttcgcggaagcgttcgctaaggcgcagctgggcagtaactccaccatgaagaaacagggccgtgcgctgctctccgtccgcgaaggcgacaaagagcgcgtggtggatctcgccgccaagctgctgaaacagggctttgagctggatgccacccacggtacggcgattgtgctgggcgaagccggtatcaacccgcgtctggtgaacaaggtgcacgaaggtcgtccgcacattcaggaccgtatcaagaatggcgaatatacctatattatcaacaccaccgcaggtcgccgcgcgattgaagactccagggtgattcgccgcagcgcgctgcagtataaagtgcattatgacaccacgctgaacggcggttttgccacgacgatggcgctcaatgccgatgccaccgagaaggtaacctcggtgcaggaaatgcacgcgcagatcaaaaagtcgtaaacaaagggtccggcggatattgctctaaccggacctgtaatataatgttgaaagggtttctgtaaagaaaccctttttttatcttgcgtaaggtcattcctggagaagtccgtttccgtaaccacattttcaatgtaataagcacgatattgctcacactaatcaatatttaagtcgcatactatcttgcatatccacaattttaatatggcttagtttttattagtttggacaggccgtagccagatttttaatttgtgaaatggtgtgcttatgtgtgaaaaatatgttgaaagaccgctttatttgttaattgctgactggatgatggcagagaaccgatggatcactgccagggagatttcccgtcaatttgatattgaacattgcaaagcaattaatacgctctcctatattctgtcagaagtgggggaaattgtttgtgaagtgaagatgatccctaaccaaattgcaggacgaggctgccagtgccagcgtctggtgaaagtcgtgagtatcgactctcaactctatcgccgattgaatcataatttgcaggaaagaaaagtgagcgtggcgaaagcgccgcggctgtctgccgttccccccacagagctaaaccgtgagcagaaatggcagatgatgctctccaagagtatgcgtcgctaattgtctgtttacctgctggcggggtaaacggtaattgacgcgtaggccggataagcgtgagcgcatccggcatcaattactgtgctgattttggcttcacgtccgtcgtgcctttcaggcgcggtcggttttcttcggcctgcgttaacggcttcgtttcagataaccccgttcgacaacggatcgcaagatcctgatattctttggtattgaggtgtttccagtgcagctcctggtccgtaacctggcgtagtacgcgcgccggtgatcccaccaggagttgccttgcctcaccctgaaatccggctttgacaaaactcatggcggcgacaatgctctcttcgccaatcactgcgccgtccataatgacgctattcatgccgaccagggcgtcccgtcccaccacgcagccatgtaaaatagcgccgtggccgatatggccgttttcatgcacgatggtatcggtatcgcagtagccatgcataatgcagccatcctgcagattagagcctgcctccaggatcaggcgaccataatccccacgcaatgacgcgagtgggccaatataaacaccggcgcccacgatgacatcgccaatcagcacggcgctggggtggacaaacgcgtccggatgcaccaccgggatcagtccttcaaaggcgtaatagctcatagttgtacctcggttttttgccggatggcggcgtaaacaccttatccggtctacggttgcgcatgtgctgtaggccggataagcgaagcgccatccggcatagtcacattaacgacctttccacaccggatcgcgtttttcggcaaatgcctgcggtccttcgagcgcatcttctgaatgcagcaccgacggataatgcttcagtacgccgctgcggatgtagcggtagccttcttctaccggcatttcgctggtcgcgcgataaatctctttcagcgccgcgatagccagcggggcgctattgaccagttgttgcgccagttcgcgcgcactctccatcagttcgctctggctgacaacgcggttcacgactccccaacgcagcgcttcttcggcgctcattcgtctgccggtcattaccatttcgttgacgatagccggtggcagcagcttaggcagacgcaatacgccgccgctgtcaggcacgatgccgagcttggcttccggcagcgcgaagctggcgttttcggcgcagacaataaagtccgccgccagcgccagctcaaaaccgccgccaaacgcgtagccgttcaccgcggcgataaccggcttatcgaggtcaaatatttcggttaaaccggcaaagccgccgggaccaaaatcggcatccggcgcttcaccttccgctgccgcttttaagtcccagccagcagaaaagaatttctccccgccgccggtaatgattgctacgcgtaattccggatcgtcacggaaattaagaaaagcttcacccattgcaaagctggttttggcgtcaatggcattcgctttaggtcggtcgagggtaatttccaggatcgggccgttacgggtcagatgtaatgactcactcatagttcatctccagataaatagttttccggcgggagggattcctgccggaaggtttatttcagattttttttgattatttttcctgaacagttgcgcggcaggtcggttctgatctccataaaagagggaaccttgaacttcgccatattgttttcgcagaagctgaaaaactcggcttcgcttaatgtttcaccttcattaaggacaataaacgctttaatggcttcatcacggatcgcgtctttaataccaaccaccacaatgtcctgaattttcggatgcgcagaaataatattttccagctcgacgcaggagacattttctccgccgcgtttaatcatgttgcagcgcctgtcgacgaaataaaaatagccatcctcatcctgatagcccgaatcaccggtatgtaaccagccctcaggttccagcgctttggcggtagcctccggctgcatgtaatactctttgaagatagtcttgccggggatgcctttaatacagatttcgccaatttctccggcgggcagcgggcgattttgatcgtcgcgaatttcagcttcatagctaaaacccacgcgaccaatggaaggccagcgccgtttgtctccgggacggtcgccaataattccgacaatggtttcagtcataccataagaggtcagcagcctgacgccaaagcgttcggtaaaatcgtctttttcctgctcggataaattgagatagaacatcacttcgcgcaggtgatgctgcctgtccgttggtgcggcgggctggaccatcagcgtgcggatcatcatcgggatgcactcggtcaccgttgcctgatatttacgtacctgatcccagaaggccctggcgctgtacttctctagcagcacaaaggtgctgccggcggaaaaggctggcattgcggcggtacactgacagtcgatatgaaaagcgggcatcaccgtcatgtacacgtcatcatcgcgcagggcgatttgccaggcagagtagtagcctgcaaaacgcaggttgtagtgggtaattaccacccctttaggccgtgaggtggtgcctgaggtaaacagaatttccgccgtatcgtcagtggataacacgggcgtatagcacagcgtggccgactggcgtgcttgtagttgggtaaagtggctcacgccgtcgtcagccggaagctgctcgccaatcagacagatatgattaagcggagtgctattgtcctggcgtatttcacggtacataggataaaactgggcgctggtaaccagcagactcacctggctgttttgcaggatccaggcgctttcttcgcccagtaagcgggcattaatcggcaccataatggcgccgatttttgccagtccaaaccagcaaaagatgaattccggacagttatccagatgcagcgcgaccctatcacccttgcggatccctaaggaataaaaaaggttcgccgtgcggttaatctcttcattgagcgaagcatagctaaactgccgaacgattccctcacaggattcgaaaattaacgccgttttatctccgtacaccccggccaggtcgtcccacatctgacgtaagttttgtccgccaacgatatccatattgctttatccactgaaatcaggcgtgagcgctaaccggaaaaccgattagcgcatcgcgtttaatcctcaactttggccaggcctttgccgaccagttccttaatatctgcttcgctataaccaatgtttttcagaatggcggcggtatccatgccgtgtgacggcatgccacgccagattttccccgggttgtttttaaatttcggcatgatgttcggccctttacaggtgcgaccgtccattgtttgccactgagtaatcgattcgcgggcaacgtactgcgggttaccttccagttccggaatggtgagcaccttcgcacaggcgatattcagttcagcaaaacgcgcctgaacgtcggcgatggtgtgtgttgccagccaggcgtccagtttctcttcgacgagcgggccgtaagggcattccacgcgatggatgagttgtgtgccttccggaacttccggcgtaccgagaatgtgggccaggccaatatctttaaaacactcgttgatttgcgtgatgccgaccaactccatgacgatgtaaccatcggcgcatttatacaggccgcaaccagcgtagtaggggtctttccctttcgtcatacgtggacagatttcgccgccgttgaagtagtccatcatgaaatactgacccatgcgcagcatcacttcgtacatggcgatatcgatgctttcacctttacccgtttcgcgtactttgtgcagggctgccagcgcggctgtcgtcgcggtcatcccggagaagtaatcggcggtatacgggaaggctggcatcggctgatcaacgtcgccgttttggatcagataaccactgaatgcctgcgcgatggtgttatacgccggaagattggtgtactcctcggtaccatactgaccgaagccggaaaggtgggcaatgaccagtttcgggttatgttcccacagcacttcatcagtaataccacggcgggcaaaggccgggcctttactggcttcaatgaaaatatcggtggtttccatcagtttcagaaacgcttcccgaccttcatctttgaaaatattcagcgacagggcgtgcaggttgcggcgtgagagctgcgggtagttaggctgtacgcggatggtatcggcccatgcgacgttttcaatccagataacctctgcgccccattcggcgaacatctgtccggcgaatggaccggcgatttcgattcctgaaaaaacaacgcgtaccccagcaagcgggccaaaggttggcattggtaaatgattcatcatttttctcctggcattttttgcggtatgtaggccggataagcacagcgccatccggcatgattgcctgatggcgacgccccgcgtcttatcaggcctacaagggatcgattagcggtattgcttaagtaccgcacgacccaacgtcaggatctgcatttcatcagaaccaccagaaacacggtcaacgcgcaggtcacgccagaaacgcgtgatgcggtggttgcccgcgataccaacacctcccagtacctgcatggcggtgtctaccacttcaaacgcggcgttggcgcagaagtatttgcacattgccgcgtcgccggaggtaatggtgccgttatccgctttccacgcggcttccagcagcatatttttcatggagttcagtttgatcgccatatgcgcaaacttctcctgaatcagctggaaacggccaatagcttcaccaaactgcacgcgctgattcgcgtaacgcgcagcgtcttcaaaagcgcacattgcggtaccgtagttggtcagcgcgacgaggaagcgttcatggtcaaactcttctttcacgcggttgaagccgttaccttcccgaccgaacatgtctttctcgtccagttcaacgtcgtcaaaggtgatttcacagcagctgtccatgcgcagaccgagtttctccagtttgttgaccttgatacctgctttgctcatgtccacaaaccactcggtgtaaaccggtttatccggcgatgcaccgtctctcgccatgaccacgatgtacggggtataggcgctactggtgataaagcacttactgccattgagataaaccttaccatttttgcgcgtataagtggttttcagactaccaacatccgatcccgctcctggttcggtgatagcagagttccacatctgcttaccggtgccccggaacgccatgattttatcaatttgctcctgagtcccttcacgcaggaaagtgttaaaacctcccggcaattggtacaacacgtaagttggcgcgccaagacgtcccagttccatccagacggcggcgacggtaacaaaacccgcttccagaccgccgtgttcttccgggatcagcaggctatcaatacccatatccgccagcgcttttacaaaacgctcagggtagacgctgtcacgatcgcactcggcaaaataagcttcccagttctcactggccatcagttcgcgaataccggcgacaaacagctcctgttcgtcatttaagttgaaatccatctttcagcctcttgatcaattgggttaataagaattacttgtctttccagtgcactttggcgtctttaataaaggacagcgtcaccataatgttgacgaagaacagcggacatcctccggcgataatcgcggtctgaatcggcttcaacccacccagcgccagcagaacgataccgatgatgccgaccagcactgaccagccgatacgcactaacagaggcggctcttcaccatcgcgaacttcgcgacaggtcgacatcgccagggtgtaagagcaggcgttaatcagcgtgacggtggcaataaagcagaggatgaagaagccccacatggtggcggtgctgagcggcaaggcggcccaggtttcgataatggcgcgcgccacgccgtgttgctcaatcagttgcggaatgttgaggatgtttttatccatcagcagcagcgtgttactgcccagcactgtccacaggatccaggtagacgcggtcagacccatcaccatcccgaagcacagctcacgtacggtacgaccacgggaaatacgggccaggaagatactcatctggatggcgtaaataacccaccacgcccagtagaaaacggtccagccctgcgggaagccgcctttaccgatggcgtcggtatagaacagcatccgtggcaggtgcattaacagcatcccgacggagtcggtgaagtagttcatgatgaagctggcgccgctgacgataaacacccagccgagcatcaggaagctcaggtagctacgcacatcgctggcgattctgacccctttttgcaggccgcaggccacgcaaatcgcgttcagaatgatccagcaggtaatgatgatggcgtcgagttgcagcgtatgcggaataccgaacagccattgcatacactcggtgaccagcggggtagccagaccgaggctggtgcccatcgcgaagatcagcgccaccaggtagaagttatcgacgatggtaccgaacaaccctttcgcatgcttttcaccgacgagcggtaccagcgtggagctggggcggatgacatccatcttgcgtacaaagaagaagtaggcgaaggccacggaaaggaagctataggttgcccacggcagcggcccccagtggaacaggctgtacgccaggcctatctctttcgcgcccgtggaatttggttccaggccgaacggcggggtggagatatagtagtagatctcaatagagccccagaacagaaccgcagcggatgtacaggaggcgaacatcatgaaaatccagctggcggtgctaaactccggtttttcgtcacctaatctctttttggcataggggccaaaaaccagccagaaccagccgaagagcatgacgaccatataccattcaaatgcccaaccccagacgttggtgacataactgaataccgcattaataacgacgttagcggcatcaagatctctgactgttagccagcaaagtatcccgacaattattaatggcggaaaaaaaaccttcggttcaattcccgattttttcttttcatttttcataagtgaattccagtgtgaaaacgaaatttatttagcgtgccagtccatgaacgtttgtttatttattattaatgatttgttgataagtttttaacctctgggacgcctcaatgagtaactcatgatgggtattcacttcgggtgattctgttatcttcgtcacacttttttgcgttgattattttgtgtctaaattttgatttttgctttatttatcaattgattggttgtggttttttaacttttttaagtatctggcgttcaatattgttgagccagcaaacaatattgaaaattttcatatttggcatatttctttcaatattggtgaggtgcgtaacactattgaaagttacgaatatcaatgtgtgacattttcaatattggtgattaaggttttatttccgaattaaagagcgtgatatctgtatttaacaccgccgatataaatacgtttccttcatgatttctggagatgcaatgaagataattacttgctacaaatgcgtacctgatgagcaggatattgcgattaataatgctgacggaacactcgatttcagcaaagcggatagcaaaatcagccaatatgatctgaatgcaattgaagctgcttgccagttaaaacagcagttgggagacgctcaggttgtcgccatgagcgttggcggcaaagcgctgactaatgcaaaagggcgcaaagatgtcctctctcgtggccctgatgaactgattgtggtcattgacgatcaatttgagcaggcgctgccgcaacacaccgctaccgcgctggccgccgccgcgcaaaaatcaggtttcgatctacttatctgcggcgacggttcttccgatctttatgctcagcaggttggtttgctggtgggcgaagcgctgaacattccggcgattaacggcgtgagtaaaatcctctctcttaccgacagcacattgacagtagaacgcgaactggaagatgaagttgaaacgctgagcatcccgctcccggcggtgatcgcggtttccaccgacattaacaccccacaaatcccttcgatgaaagccattcttggcgcggcgaaaaaaccggttcaggtctggtcgcctgcggatatcgggctgaacagcgtacccgcgtattccgcacaacaggttgccgcaccgaagcagcgcgagcgtcagcgtgtggtgattgaaggtgacggtgaagaacaaatcgccgcgtttgtcgagaatctgcgcaaaatcatttaattatcaggggatgttatgaacaaattttccagtgtctgggtattcagcgataccccttctcgtctgcccgaactgatgagtggcgcgcaggctgtaggtgaaaaagttaacgcgttcgtactgaacgaagcagacagcgcgacagcatgtcatttgggcgcggatcatgtctggctgctcagcggcaaaccagaagaccgcatgatcgaagactacgctgctgcgatggctgagactattcgtcagcatagcgagggcggcgcggtgctgctgccgaatacgcgtcggggcaagctgttggcggcaaagctgggctatcgcttgtcggctgcggtttccaacgatgccagcgacgtctccctgcaggatggaaaagcggcggttaaacatatggtctacggcggtctggcgataggggcagaaaccatcgcttcgccgtttgccgtgatcacactcagcagcggaacgtttgacgcacaacaaccggatgcttctcgcagcggcgagatgcacaccgtgcagtggcaggctccggccactgccgtgacccgcaccgcaacccaggcgcgtcagagcaacagcgttgacctcgacaaagcgcgtctggtggtcagcgtgggacgcggcatcggcagcaaagagaatatctcgctggccgaagcgctgtgccagacgattggcgccgagctggcctgttcccgcccggtggcggaaaacgagaagtggatggagcacgagcgctacgtcggtatctccaacctgatgctcaaacctgaactgtatctggcggtggggatctccgggcagatccaacacatggtcggcgccaacggcgcgcagacgattttcgccatcaacaaagataaaaacgcgccaatcttccagtatgcagattttggcatcgttggcgatgcgctgaagatcctgcctgcgctgacggctgccttagcgcgataaaccatttcgggcaggatgcgaaggtatcctgccgctgacaggagtacgtatgtccgaagatatctttgatgccatcatcgtgggtgcaggtctggccggttcggttgcggcgctggtgcttgctcgcgaaggtgcacaggtgctggttatcgagcgcggcaattctgctggcgcgaagaatgtcaccggtgggcgcttgtatgcacatagcctggaacgcatcattcccggctttgcggatcaggcccccattgaacgcatgatcacccacgaaaaactcgcctttatgaccgacaacggggcgatgactatcgactactgcaatggtgaagatgcttcagcgtcgcaggtttcctattccgtcttacgcagtaaatttgacgcctggctgatggagcaggccgaagaggcgggggcgcaactgatcaccggtattcgcgtggataacgttgttcagcgtgatggcaaagtcgtgggcgtggaagccgatggcgatattctggaagccaaagtcgtgatcctcgctgacggggtgaattctctgctggctgaaaagctgggcatgaccaagcgtgttgaggcatcgcatgttgctgtcggcgtgaaggaactgatcgaattgccgaagttggtcattgaagatcgtttccagttacagggcaacgaaggtgccgcctgtctgtttgccggagcgccgaccgatggtctgatgggcggtggcttcctgtatacgaatgaaacaaccctttccctggggctggtctgcggtcttcatcatctgaaagacgcgaaaaaatcggtcccgcaaatgctggaagatttcaaacagcatccggcagttgcgccgctgatcgccggtggcaagctggtggaatatgccgcgcacgttgtacccgaggcgggaatgaatatgcagcctgaactggtgggcgatggcgtactgattgccggggatgctgccggcatgtgtatgaacctcggctttaccatccggggtatggatctcgccatatccgcaggcgaagcggcggcgaagacggtgctttcggcgatgaagcgcgacgattttagcaagcagtcgctgggtgaataccgtcagcatctggacgaaggtccgatgcgcgatatgcgcatgtatcagaaactaccggcttttcttgataatccccgcatgtttaccgcttatcccgaaatggcggtcaatatcgcgcgcgacctgttcaccgtggatggctccgctccggtgcccatgcgtaaaaaaatcctgcgccatgcgaagaaagtgggcttcattaatctgatgaaagatggcctgaaaggagtgaccgtattatgacatctcccgttaatgtggacgtcaaactgggcgtcaataagttcaatgtggatgaagacagcccgcacatcattctcaaaaccgatcctgataaacaggcgctggaggtgctgattaaggcctgtccggcgggactgtataaaaagcaggacgacggcagcgttcgttttgattacgccgggtgcctggagtgcggaacgtgccggatcctcggccttgatacggcgctggaaaaatgggaatacccgcgcgggacgtttggcgtagagttccgctacggctaataagtacgaagttgtgcccccgttggccggataagatgcggtagcgtcgccatccggcaatcatgtggcgccaatgccggatggcggcggaaacgccttatccggcctacagatgcgctttgcccgtgttgaaacaggacatcaccatgcagcagcccaggaactttgatgaccttaaattctcctccattcatcgcagaattatgctgtggggaagcggcggcccgttccttgatggctacgtgctggtgatcattggcgtggcgctggaacaactgacgccgctattgcaccttgatgctgaatggattggcgcgctcggcgcggctacgcttgccggactgtttatcggcacctcgttgtttggctatatttgcgataaagtcgggcggcgtaaaatgttcctgcttgatattatcgctatcggcgttatctccgtggcgaccatgtttgtttccacgccgcttgaattactggtgatgcgcgttttaattggcattgttatcggcgcggattaccctatcgctacttccatgattacggagttttccaacacccgccagcgcgcgttctccatcggttttatcgccgcgatgtggtacgtcggcgcgacctgcgccaacctggtgggctactggctgtatgacatggaaggcggctggcgttggatgcttggcagcgcctttatcccgtgcttaatcattttgattggccgctttgacctgccggaatcgccacgctggctattgcgaaaaggacgggtaaaagagtgcgaacaaatgatgatcaaactgttcggcgaaccggtctgctttgacgatgagctgccgcaggagacccgcttcctgcagctgtttaaccgccgtcatttcccgtttgtactgttcgttgcggctatctggacctgtcaggtgatcccgatgttcgctatctatacctttgggccgcagatcgtcgggttactcggctgggagcaggggcgcaacgcggcgcttggcaatgtggtgattagcctcttttttatgctgggctgtataccggcgatgttctggctaaacagtattggccgtcgccctctgcttattggcagcttcgccatgatgactatcgcgctggcgctgctggggctggtgtcaaatctgggcatcatactggtcgtggtggcgtttgcggtatacgccttcttttccggcggaccgggcatactgcaatggctttatcctaatgaactcttcccgacggatattcgcgcttcggccgtgggggtcatcatgtcattaagccgcatcggaaccattgtctccacctgggcattaccgatttttattactcgttacggtattaataacgtcatgctgattggcgcgttgatttcgttagtcgggcttggcgtatcggtgatgtttgccccggaaacccgcggcttgacgctaacacagaccggaaacatgactttgcgcggaacgccatcggataaccctcgttaagagtgttctgcatttctccctgcttttcgccaataacgctacagttaacagtcacatgctaaaacaactgaaaagcagggagaacaccatgcaaaaacgtcttatgaccgcactgtttaccgcagcaacactattcaccgtcgcaggatgctcttctaaccaggcggttgaaaccacggatggcaaaactattgtcaccgacgggaaacccgaggtcgataacgataccggtatggtgtcttacaaaaacgccgccaccgggaaaaccgaacagattaaccgcgatcagctgaaaaatatgagcgagctggataattaattcaatcttttctggttagccgcgcaataatattttctctttatgcgcatccatttattcccatgcgaataaacggatgcctgaacaggcagggacgccggaaaacgtcgaaatacgttagaccattcgcccgtgttcccgctttccccaccgcgctgtccgcttacatgaggttacactcatcgacatttctctgaacagcggctcaacatttcccggaaaaaaacatatcgcagggcatttatccttatgattaggtataaatgatgaggtataaggaacaggagtctgtaatgaaaccaatacctttttatttgctcgcgctattttctgccgcctccggggctacggagataaacgtctgcaaagacctgatcggaacatggaaaaccacggcagataacccgccttataccatgacaatatcgccgccagtagaaagctgcggggaaaaatgtgtgaaactgaacgtgcagtatgaacttgacgtgactcaccgcaacgcgctttattgccatgaaggacaagagggggtaaaagggcagggacccatggtgatagcatttgaaggggcgtatggtggacacgctattggaacctataaccgacagctgcaattactttgggctggcgtaatatcgaaaaataaaaaggggaaatggataacgaaaatggaaaattactggttcaggcaggtaaaagcgcactaaacatcatcttaaaacagcccgcaaaaccgtcttattcacgaagggcttactgcctgcgcgcgcacattccaacggcttgcctgccccggatgaactgttgataaaaaagagggccagcatccgtttccagacggccctgagtggattgtgacgtaacatggcaccttgctggcgctctcttattatttcatgccagtgccctcgttatggcgcaatcagagctttatttcgtcgcatcgttataaacttcggcaacggcttcaaaattcggaccatgctcacgtgcagcgataatatggtaatattttccgcctttcgcatcggctaattctgacagtttttcgcgtagatcagagggtgaggaaatctgtccgccactctgggacacatttatggtgccgaccttaaccagtttgaagtggctgatttcttgtttagagacctgctctgccgcaagtgtgctgaatgaagcaaccgttgccagtaatgcggcggcaataatgcgttttttcatagttctgttcctgttgcattgatgataaggtttgcgcaatatcagtaatccgtaacgaaattatttatccccttcatacttcaggttgcttatgggttggctacggattactcggcccacccatgggcctcgccctgacgggccgtcgcacgcgacgttcaaatctgctcccggcaaatttgtcgctcacctcagtcacataattatctatgctcccggggactcactcccttgccgcctttaagcaactcgaattattttgggtaataacctcggttgattatctgaaaatagccttatttggtgtgaccgtcttttatcttgttatagtcacctctttatgttgttgtcaatgtaaaataatgcactgccagctaaaaagaaacttaaccccctgtaaataatagtttttatattatttcttttaatggcgtaatttttattgaatcacgcggcaatacgctagttttattcataagcaacataacagaattgagttatgttttaatttcccagagtgatattaccggttgtatgtctatggttgcgcggcctgttactgatagtgtttctttcggggcgattttattgtagcggcatagggtaatcaccgtagctgaagggaaaaggcacgaacacagcactatagagtatgtttaataatgtatttttttatgaagtaatgtctgcagttgtatctctaaaataaaaacaatgaacttttcatctaaataatttttcagtgaattatggttatttattaatatatttctaatttgaaatacaaatcaatttataacacatattcttacccggaaggcattgatacatatccacgcttcctcgtacagtaataaatgaatatgtgataaagttactgactacaggtataataatatgagtaataaaaaaaatctgtccgcagaagagacggatcttacgcgtaggaaactgttaaccagtgccggtattcttgccgcaggcggtatgttatccggcgcggtaaaggctgatgaaaaatgcgccgtcaaggcgaaaccggcgtgggataaaccgtttactggcgaaatcccggaaaaattgccagaaggatataatattctgttagtcgtgaccgaccaggagcgtttttttcctacgtttcctttcccggtacccggcagagagcggctcatgaaaacgggggtgacattctgtaatcatcagaataccagtaatgtctgtacgccttcccgctccgtattgtataccggcttacatatgccccagacaaagatgtttgataatttgggattaccctggatgccttatgaccttgaccccgctcttggaaccacaggtcatatgatgcgggaactgggatactatacggcctataaaggtaagtggcatcttacagaaaaactggagaagcctttgcctgacgaaaaagatgaggatattgatgtcggggatattcctgaaccagaattacataaaattatggaaaaatatggttttgctgactatcacggcatcggcgatattataggccatagtaaaggcggctatttttatgattcaaccaccacggctcagactataaattggttaagatgcaaggggcagcccttgaatgaccaacacaagccctggttcctggccgttaacctcgttaatcctcatgacgtcatgtttattgataccgataaagagggagaaaaggtacagtggcgtggcgagttggatcaggatgataataccctggcgcccacgcagccaccggaaaacgaactttatcaggcaagctggccgaactatccgctgccggcaaacaggcatcaatcattcaatgagcagggaagaccgccggcgcatcttgaataccagacggcgcgcgctgcgctggaagggcagtttcctgatgaagatcgtcgttggcgtaaactgcttgactactatttcaactgtatccgcgattgtgatactcaccttgaccggatattaaatgaacttgatgccctcaagttaactgataaaacgattgttgtatttactgccgatcatggcgaattaggcggaagccatcagatgcacggtaaaggcgcttccgtttataaagaacagatccatgtaccgatgattatttcccacccggcgtaccccggtaataagaaatgtcaggcgttgacctgtcatcttgatatcgcgccgacattagttggactgaccggtttgccggaagaaaaacagcaccaggcgttaggcaaccgcaaaggcgttaattttagcggattgctaaaaaacccggagagcgttgcggttaatgcggtgagaaatgccagcttatattgctatggcatgatcttgtataccgatgcccattatctccaccgcgttattgcgctacaaagagataaacaaaaaacggtggcgcaaatcaagcaggaaatatctcatttgcatcctgatttcagccatcgttcagggacgcgcatgattaacgatggtcgttataagtttgcacgctatttctcgctaagggagcataatacgccggaaacctgggaggatcttattaagtacaacgatcttgaactttacgatcttaaaaatgatcccgatgagaaccataaccttgctgctgataaacagaaatatcaggatctcattcttacgatgaatgaaaaactgaataaaattatcaaagacgaaattggcgtggatgacggcagttttatgccggatgcggcccatgagccgtgggatcttactattgagcaatttaaccgcatggcgaaagattaagagcctggcccattaggctattttattcgtcggcgatctggcatccagcgtgtctggaggttcagatgctgttggcgctgcgcttattgggtctgtatcatcatgtaatggattgatattacagtcattacaggcaaatttagcgcagcgccgcccgacaagaaggccttaaaccgattggtcagcgatttaaggctactatcatcaccgacctttccacaccggatcgcgcttttccgcaaacgcctgcggcccttcgagagcgtcttccggaggcaggacggcgccagctcctggctggcgttaattcaattttttctgattagccgctcaataatattcactattagcctggcgaatttgtcactacactttgtaataaaaaacagatcatcacaggctaatcatgatcctcattatttatgcgcatccgtatccgcatcattctcatgcgaataagcggatgcttgaacaggcagggacgctggaaaacgtcgaaatacgttcgctttatcacctctatcccgatttcaatattgacgttgccgccgagcaggaggcgctgtcgcgcgcgagtcttatcgtctggcagcatccgatgcagtggtacagcgtccctcctttactcaaattatggatggataaagtcctcacccacggctgggcttacggtcatggcggtacggcattgcatggtaaacatctgctgtgggcggtaacgaccggcggtggtgaaaaccactttgctatcggctcccatcccggatttgacgtcctttctcagccgctacaggcgacggcgctctattgcggcctcaaatggctgtcgccgtttgccatgcactgcacgttcatttgcgatgacgacaccttacaggcgcaggcgcgtcagtataaacagcgtttactggcatggcaggaggtgaatcatggatagccatactctactgcaggcgctgatctatcttggttcggcggcgttgattgtgccgattgcggtacgtttgggcttaggatcggtgctggggtatctgattgcgggttgcattatcggtccctgggggctacggctggtgacggacgccgaatctattctgcattttgcggaaatcggcgtcgtgctgatgttgtttgttattggacttgagctggacccgcaacggttatggaagctgcgcgcctcggtatttggcggcggcgcgttacagatgggggtctgcggcggactgattggtctgttctgtatgtttcttggcctgcgttggcaggtggcggaactgattggcatgacgctggcgctttcgtccacggctatcgccatgcaggcaatgaatgagcgtaacctgaccgtttcgcaagtagggcgtagcgcatttgcagtgctcttgttccaggatatcgcggcgatcccgctggtggcgatgattccgctgctggccgccagcggcgcatccaccacgcttggcgcgtttgcgctatcggcgttgaaagtcgcaggcgcgttggcgctggtggtgttgctgggacgctacgttacgcgcccggcgctgcgctttgtcgcgcgttctggtttgcgggaagtgttcagcgccgtggcgctatttctggtgtttggtttcggcctgttgctggaagaggttgggctgtcaatggcgatgggcgcgttcctggcgggcgttctgctggcgagttcggaataccgtcatgcgctggaaagcgatattgaaccctttaaggggttgctgctggggctgttctttattggcgtcggcatgtcgattgatttcggcacgctggtggagaatccgctgcgcattctgctgttgttggccggttttctggcaatcaaaatcgtcatgctgtggctggtcgcgaggccgctgggcgtaccggcaaaacagcgtcgctggtttgccgtcttattaggccagggaagtgagtttgcgtttgtggtttttggcgcggcgcaaatggcggatgtacttgagccggaatgggcaaaagcgctgacgctggcggtcgcgctgtcgatggcggctacgccgatttttctggtgctgctgacgcgcatggagaagaccgcgacgggtgaagcgcgcgaggcggatgaaatcgacgaagagcaaccgcgggttattgtggccgggtttggacgatttggtcagatagccgggcgtttgctgctgtcgagcggggtgaagatggtggtgctcgatcacgaccccgatcatatcgaaacgctgcgtaaattcggcatgaaggttttttatggcgacgcgacgcgtatggatttactggaatctgccggagcggcgaaggcggaggtattgattaacgccattgacgatccgcaaaccaatttgcaactgagtgaactggtgaagtcgcatttcccgcatctgcagattatcgcccgcgcccgtgatgtcgatcattacattcgcctgcgccaggctggtgtggcgatgcccgaacgtgaaaccttcgaaggcgcgctcaaaagcgggcgacaggcgctggaggcgctggggctggggcgttatgaagcccgcgagcgcgcggatctgttccgtcattttaatacccggatggtggaagagatggcgaaaggggaaaacgatccgttatctcgcgccgccgcctataaacgtaccagcgcgatgttgagcgaaattattaccgaggaccgggagcatctgtcgttgattcagcgccacggctggcagggaacggctgagggcaaacattccggggaggtcgccgatgaacccgaggtcaaaccgtcaatctaaagtaaaaaatgtgatgttctgcaaactttactgctaattggctgtttttgaactactgtaatgctggcgctccacatcaaatgagtggcgtcgccagcagaacgaaaaattttcgtgctcatcctcttttcgtcagtcgacgaaagattgcgctttacgtatagtggcggcaattttttttgtatcaggaaataattaatgatcagtctgattgcggcgttagcggtggatcgcgtcatcggtatggaaaacgccatgccgtggaacctgcctgccgatctcgcctggtttaaacgtaacacgttaaataaacctgtcgtcatgggacgtcacacctgggagtccatcggacgccccttaccgggacgtaaaaatattgttatcagcagccagccaggcaccgacgatcgcgtgcagtgggtgaagtctgtcgatgaggcgattgccgcttgcggcgatgcgccggaaattatggtcattggcggcgggcgcgtgtacgagcagttcctgccaaaggcgcagaagctttatctgacgcatattgatgcggaagtcgaaggcgatacccattttccggattatgaaccggatgactgggaatcggtattcagtgagtttcacgatgccgacgcgcagaattctcacagctattgtttcgagattctggagcgtcgttaacgctgtagtgccggatggcggcgaaacgccttatccggcctactcttgagccagatgtcgccagatgtaggcctgataagcgtagcgccatcaggcataaacctatcaggcgttgaccgcttcgccttcgcccatatccatctggcggtttgacggctgcacaaaatactgtttatcttcccagcgtaaacaggtcaactccccgccccagcagcagccggtatccagcgcgtaaataccttccggcgtccctttcccttccagcgacgcccagtgcccgaacgcaatactgtaagcctcgctcaccggccccggaatggcgaaccacggcttcagcggcgcaggggcattttccggcgacgctttgctgtacatatccagttgaccgttaggaaagcagtaacgcatacgggtaaaggcattagtaataaagcgtagccgcgccagaccgcttaactccggcgaccagttattcggcatatcgccatacatcgcgtcgaggaaaaacgggtacgagtcactcgacagcaccgcttcaacatcgcgggcgcactcttttgccgtctgcaaatcccactgcggggtaatacccgcatgcgccatgaccagctttttctcttcatctacctgcaacagcggctgacggcgtaaccaattcaacagctcatcggcgtccggcgcttcaagaagcggggtcagccggtctttaggtttgttgcggctaatcccggcgaatacggccaacaggtgtaaatcgtgattccccagcaccaaacgcacgctattgccaagcgatttgacgtagcgtaacacgtccagcgaaccgggaccgcgggcgaccaaatcgccagtcagccacagagtgtctgtgtctggcgtaaattccacttgctgtaataaggcgatcagttcgtcgtagcaaccgtgaacgtcgccgatgagataagttgccattgttataattttagtgaatgagtgtagggacggcgagtcgaaacacggggatgtcgatggtaaaggcgtcgccattttcatcgatcatttcgtaatgaccctgcatggtgcccagcggcgtttcaattaccgcgccgctggtgtactggtactcttcgccaggcgcaatgcgcggctggacgccaaccacaccttcgccctggacttcggtttcacggccatgaccattggtaatcagccagtagcggcccaatagctgcactggcgcccggcccagattgcggatggttacggtataggcaaaaacgtaacgttcatcgtcaggtgaggattgcgcctcaatgtagacgctttgcacctgaatacacactctgggcgaattgatcatgtttaactctccttcaaaggcgcgttttccgacagatagttggccatctggcagtactgcgcgacagagatattttccgcgcgcattgccgggtcaatacccatttccgtcaacgtctcaacgctaaaaagattgccgagactgttacggatcgttttacggcgctggttaaaggcctcggtggtaatacggctcaacacgcgaatatctttaaccgggtaaggcattgttgcgtgtggaaccagacgcaccacggcggagtccactttgggcggcggcgtgaaggcggatggcggcacttcaagcaccgggatcacctgacagtaatattgcgccatcacgcttaaacgaccatactctttgctgttcggccctgcaaccagacgatttaccacttctttttgcaacataaagtgcatgtcggcaatggcatcagtatagctaaagagatggaacatcagcggggtggagatattatagggcagattgccgaacacacgcagcggttggcccaactgcgcagacagttcgccaaagttcatggtcatggcgtcctgctgataaatagtcagcttcggccctaaaaacggatgggtttgcaaacgcgccgccagatcgcggtcaagttcaatgaccgtgagcttatccagtcgttcgccgaccggctccgtcagcgccgccagaccggggccgatttcaaccatcgcctggcctttttgcggattaatagcagaaacaatactgtcgatcacaaaccgatcgttgagaaagttttgcccgaagcgtttacgggctaaatggccctgatggactcgattattcattgggtattaacaatcattttgatggcgagattaagcgccgtaataaaactgccgacatccgcttttccacggcccgccagttcaagcgcggtgccgtggtcaacggaggttcgaataaaaggtaggccgagcgtaatattcactccccgaccgaatccctggtattttagcacgggcaggccctgatcgtggtacattgccagcaccgcgtcggcattatcgagatatttgggctgaaacagcgtatcagcaggtagcggcccgttgagtttcatcccctgcgcccgcagctcgtcgagcaccggaatgatggtgtctatctcttccgtgcccatatgaccgccttcgcccgcgtgcggattcaggccacagacaagaatgcgcggttcggcaataccaaatttggtccgcaaatcgtgatgcaaaatagcaatcacttcgtgcaaaagcgcaggggtgatggcgtctgcaatcgcccgtagcggcagatgcgtggtcgccagcgccacgcgaagttcttcggttgccagcatcatcacgacttttttcgcctgcgaacgctcttcgaaaaactcggtatgaccggtaaacgaaatgcctgcgtcgttaataacgcctttgtgcacggggcctgtgatcagcgcggcaaattcaccgttcagacagccatcacacgctcgcgccagcgtctctaccacgtaggggccattttctaccgtcaactgaccggagatggcaggcgcgcgcagcgagaccggcaatagggtcagcgttcccgcgggctgcggcgcagcggggacatcaggcgagtaagggagaagcgagagaggcaggccgagcatggcggcccgctccgtcaggagcgcgccgtccgcacagacgaccagttcaatcggccacgcgcgttgcgccagttggacgacaagatcggggccactcccggcgggttcgccgggagtgataacaacgcgttgcgcactgctcattagttactcaaaatcttaacgtaagcgctggcgcgctgttcttgcatccaggtcgccgcttcttctgagaatttacggttcatcagcatacgataagcgcgatctttctgcgccgcatcggttttgtctaccttacgcgtatccagcaattcgatcagatgccagccgaaagaggagtgtaccggcgcgcttatttggcctttatgcagcttcgttagcgcgtcgcggaacgccgggtcgaaaatatctggcgtagcccaacccaaatcaccgccctggttagcggagcccgggtcctgagagtactctttcgccgcagcggcaaaggtggttttaccactcttaatgtcagccgcgatttcttccagcttcaggcgcgcctgctgatcgttcatgatcggcgacggcttaagcagaatgtgacgagcgtgaacttcggtcacggagatactctggctctgaccgcgcaggtcatttactttcagaatgtggaagccgacgccggagcgaatcgggccgacaatgtcgcctttcttcgcggtgctcagcgcctgggcgaaaatccccggcagctcctggatacggccccagcccatctgaccgccttttagcgcctgctggtcggcagagtaggtaatcgccagtttgccgaaatctgcgccgttacgcgcttcttcaacaatgctttccgcctggcgctgcgcgtcgttaacctgctcggaggttgggttttccggcagagcaatcaggatatggctcaggttcagctcggtgctggcatcgttttgggtgccaatctgttttgccagcgcgtcaacttcttgcggcaaaacggtgatacggcgacgaacctcattgttgcgcacttcagagataatcatctctttacgaatctggttacggtaggttgaatagttcagcccatcgtaagccagacggctgcgcatctgatccatcgtcatattgttttgtttggcgatgttggcgatggcctgatccaactgctcatccgtgatcttcacccccatcttctgacccatctgcaggataatttgatccataatcaaacgttccaggatctggtgacgcagcgtggcgtcgtccggaagctgctgacctgcctgacccgcgttgagtttgactgattgcattaagccatcaacgtcgctttccagcacgacgccattattgacgacggctgcgactttatcgactacctggggggcagcgaaactggtattcgcgatcatggcgataccgagaagcagcgttttccagttcttcatactttttccatttcaattaaccgcaatgcggattacgttgtaaatcaatcagattacatagagctttggtacggcagaatgttcgaacgcaacatttcttgcgtgccgaggccgtagttagagctcaaaccgcgcagctcaatgttgaagccaatcgcgttatcataaatcgcgtgttgtttatcgttatcccaaccgttcagcttacgttcgtatccgacgcggatcgcatagcagcaagagttgtactgcaagccgagcatctggtctgcaggtttgctcgaattggtatcgaagtagtacgcgccgacaatcgaccagcgatcggcaatcggccaacttgccaccgcgcccacctgattgatgccgtttttatactgctctgccgtggaataatacgaaggcaacgtagcctgaatatattccgggctggcatagcggtagttcaactgtaccagacgatcctgatcccgacggtattcgaggctgctgctgctggtagcgacgctatccagacgggtatcgtactgcactccgctacgcagcccccagcgttctgaaatacgccagtaagtgtcgcctgcccaaaccagcgaaccggttttgtcgtcattctcccatttaatgttgtcatcgccggtgcgagactccgtgaaatagtagatttgaccaacagaaacgttaaaacgttcaacggcggcatcatcataaatgcgtgttgtgacgccggttgtgacctggttggcggaagcaatacggtcgagaccgccataagtgcggtcgcggaacaggccgttatagtcggattgcagcaaagaagaatcgtagttatagatgccgctctggtcgcggtacggcacatacaggtactgcacgcgtggttccagcgtctgggtataccccggcgccagcatcgccatatcgcgttcgaagatgagcttaccgtcgactttaaactgcggcatgacgcggttaaccgaatcttccagcttatttttattgtttggatcgctgttatagctgtccagattcgtttgctgatagtgcgtcgccatcagcttcgcttcggtgttcaggctgccccagcggttggagagcggcaaattgatggttggctccaggtggacgcgggtcgcttccggcatattgtctttggtgttaacaaagtgcaccgcctggccgtaaatccgggtatcaaacgggccgagatcgttatggtagtagttaacgtctaactgcggctccgctgaatagctgctggtgttttgatcgttaaagacctggaattgtttggtcgacaccgtagcgtcaaagttttgtacggcgtagccgacgctgaatttctgcgttgcgtagccgtcggtactggaaccgtacttactgtcgaaatcgttaaagtagctggagtcgctgactttggtgtaatcgacgttaaaacgccacacctgatccatcacgcctgagtgctgccagtagaataaccagcggtgcttatcgccctctttggggtgatcgtcctcgtagactttatcagaaggcagataatctaattccatcactccctcgcctgcctgcgtgagataacggaattcgttctcccacataatattgccgcggcggtgcatatagtgcggggtgatggtggcgtccatattgggcgcgatgttccagtaatacggtaagtagaactcgaaatagttcttggtcgtgtatttcgcgttcgggatcaggaaacctgagcgacgcttgtcaccgacgggtagctgtaaataggggctataaaagatcggaaccggacctactttaaaccgggcgttccagatctccgcaacctgttcttcgcggtcatggatgacttcactccccaccacgctccaggtatcggagccaggcagacaggaggtaaagctgccgttttccagaatggtatagcggttttcgccgcgctgcttcatgagatcggctttaccgcgcccctgacggcccaccatctggtaatcgccttcccagacgttcgtgtctttggtgttcaggttcgcccagcccttcggccctttaaggatgacctgattgtcatcataatgcacattacccagcgcatcgacggtgcgtacaggttccggctgaccttccgcctgcttctgatgaagctgcacttcatccgcttgcaggcggctattcccctgcataatgtccacgttgccggtaaaaacggcatcgtccgggtagttacctttagcgttatcggcattgatagtaaccggcagatcgttggtatcgccttttaccagaggacgatcgtagctcggcacgcccaacatacactgtgaggcgagatcggctgccagcccctgatgactataaagggcgctggcgatcatggtggccagaagagtgggaatacgttttttcatacgttgtatttattgttccatcatcggtagcgttgcgcgtgacaaacggtcacagcctaacttactcatcttcgctgcgccagtgttaatcctgccgtttagcgtctgtggtgttaggcacggcattgaatgacaggtatgataatgcaaattataggcgatgtcccacaattgaccgtagccttcatttgcagaaaagcaccttattttgtgggagatagcctcaccgatagcgtaacgttttggggagtctatgcagtactggggaaagataattggcgtcgccgtagccctgatgatgggcggcggcttttggggcgtggtcctgggtctgctggtgggccatatgttcgacaaagcccgcagccgaaaaatggcgtggtttgccaaccagcgggaacggcaggcgctgttttttgccaccacctttgaggtgatgggccacttaaccaaatcaaaaggacgggtgacggaagcggatattcatatcgccagtcagttgatggatcgtatgaatttacacggcgattcacgtactgccgcgcagaacgcctttcgggtcggaaaagcggataattacccattacgtgaaaagatgcggcagtttcgtagcgtctgcttcgggcgttttgatctgatccggatgtttctggaaattcagatccaggcggcgtttgccgatggctcgctacaccctaatgagcgggaagtgctgtatgtgattgcggaagagttaggtatttcccgcgtacagttcgatcagtttctgcgcatgatgcagggcggcgcgcagtttggcggcggttatcatcaacagtccggcggcggctggcagcaggcgcagcgcggcccgacgctggaagatgcctgtaatgtgctgggggttaaaaccaccgacgatgcaaccaccattaaacgcgcttatcgcaaactgatgagcgagcatcatcctgataagctggtggccaaagggttgccgccggaaatgatggagatggcgaagcaaaaagcgcaggaaattcagaaagcgtatgagctaatcaaagaacagaaaggcttcaagtgattgaattgccggatgcggctagcgccttatccggcctacgttaatgaatgtaggccgggcaagcgaagcgccccggcataaattggctcagaatttaaaaatctgccgggactttaaacgtcatgctgttaccgtaagcgggatgggtaatggtcagcatttcggcgtgtaactgcaaacgcggcgccagcgacaacgcttccggcgaggcgtaaaaccgatcgcctaaaatcgggtggcctaacgccagcatatgcacacgaagctgatgcgaacgtccggtgatcggcttgagcaccacgcgggcggtattatccgccgcaaactccaccacgttatattccgtttgcgccggtttgccggtttcataacacactttctgctttggccggttcggccagtcgcagatgagcggtaagtcaaccagcccttccgccggggagggatgaccccatacgcgcgctacatactgctttttcggctcacgttcgcggaactggcgttttagctcccgctccgcggctttggtcagcgccactacaatcacgccgctggtggccatatccagacgatgcaccgattctgcctgcgggtagtcgcgctggatacgcgtcataatgctgtctttgtgcgcttccagacgccccggcacggacaacaggccgctgggcttattgaccaccataatgtgctcatcctgatacaggataaccagccagggttcctgcggcggattgtagttttccatccccatgtacggctccgttattggtgcgtgacgacgataagacgcagcgcgtccagacgccagcctgcctgattcaggctttccagcacctgctgacggttgctgtcgatagcggcaagttcgtcgtcgcgaatgttcgggttgacggcgcgcagcgcttccagacgcgacagttccccggacagtttttcatccgcctcgcggcgcgcgttatcaatcagcgctctggcggacttttcaatctgcgtctcgcccagttgcaaaatggcgtggacgtcctgttgaacggcgttcaccagtttgctaccggtgtggcgattcacggcgctgagctggcggttgaaggtttcaaactcgacctgggcggccagattgttgccgtttttatctaacagcatacgtaccggcgtcggcggcaggaagcggttcagttgtagctgtttcggcgcctgcgcttccacgacgtaaaccagttcgaccagcagcgtgccgacgggcagcgctttatttttcaacagcgaaatggtgctgctgccggtgtcgccggagaggatcagatccagtccgttacggatgagcggatgttcccaggtaataaactgcgcatcttcgcgagacagggctacgtcacgttcaaacgtgatagtacagccgtcttccggcaggccggggaaatccggcaccaacatgtggtcggacggcgtcagcacgatcaggttgtcgccgcgatcgtcctggttaatgccgacgatatcgaacaggttcatggcgaacgcaatcaggttggtgtcgtcgtcctgttcttcaatgctttgtgcaagctgttgggctttttcaccaccgttggagtggatctccagcaggcggtcgcggccctgttctaactgggcttttagcgcttcatgttgctcgcggcaggatttgatcagatcgtcaaacccgtcggtttcttcaggcgcggccagatagttaatcagactggcgtaggctgaatcataaatcgcgcggccggttggacaggtgtgctcaaaggcgtccagcccttcgtgataccagcgaaccagcaccgactgggcggttttttccaggtacgggacgtggatctggatatcatgcgcctggccgatgcgatccagacgaccaatacgctgttccagcagatccgggttaaacggcaagtcgaacatcaccagattgctggcaaactggaagttacgtccttcggagccgatttcggaacataacagcacctgcgcgccggtatcttcttcggcgaaccaggcggcggcgcggtcgcgttcgataatcgacatgccctcatggaacacggcggcgcggatgccttcgcgttcgcgcagcacctgctccagctgtaacgcggtggtcgctttggcgcagatcaccagcactttttgcgaacgatggctggtcagatagcccattagccactcaacgcgtgggtcgaagttccaccaggtgccggtatcgccttcgaactcctgataaatttgttccggatagagcatatcgcgggcgcgatcttccgggcttttacgcgcgcccataatgccggagaccttaatggcggtctgatactgggtcggcagcggcagttttaccgtatgcagttcacgtttcgggaaccccttgacgccgttacgggtgttgcggaacagaacgcggctggtgccgtggcgatccatcagcatcgacaccagctcatcacgggcggcctgcgcatcgtcgcgatcgctattagcggcctgcaacagcggttcaatatcctgttcgccgatcagatcgcccagcctgttcagttcgtcgttgctgagtttattgcccgccagcagcatggccaccgcatcggcgacaggtcggtagtttttctgttcttcgacaaactgttcgaaatcgtggaaacggttcggatccagcaggcgcagacgggcgaaatggctttccatccccagctgttctggcgtggcggtcagcagcagcacgcccggtacgcgttcagctaactgttcgatggccatatattcacggctcggcgcatcggtactccacaccagatgatgcgcttcgtcgaccaccagcagatcccactcggcgtcgcacaaatgttccagacgctgcttattacggcgggcgaaatccagcgagcagatcaccagttgttcggtttcaaacgggttatacgcgtcgtgctgcgcttcggtatagcgttcgtcatcgaacagcgcgaagcgcaggttgaaacggcgcagcatttctaccagccactggtgttgcagggtttccggaacgatgatcaatacgcgttccgccgcgccggataataactgttgatgcagaatcatcccggcttcaatggttttacctaagcccacttcatccgccagcagtacgcgcggcgcgtggcgacgacctacatcatgagcgatattaagctgatgcgggatcagattggtccgctgaccgcgcagaccgctgtatggcatccggtactgctcgctctgaaatttacgggcgcgatagcgcagcgcgaaccgatccattcgatcgatttgaccggcgaacagacgatcctggggcttactgaaaaccaacttgctgtcgagcagaacttcgcgcaacgtcacattggtctcttcggtatccaggcgggtgccgacataaacaagcaggccattttcttcttttacttcatcgatatgtagctgccagccttcatggcttgtaatcgtatcgccagggttgaacatgacgcgggtcacgggagaatcactgcgcgcatacaggcggttttcccccgtggacgggaaaagtaaggtgacggttcgcgcatccatcgcaacaacggttccaagtcccagctcgctttctgtatcgctgatccagcgttgaccaagtgtaaaaggcatatgtgttcggctctatatctttaattgcaggcattactcgccattcccaggcgacagcactggataattgcgagtatacgaccccgctaccaggctaatgtggtagtggcgttaattaggtccaggaatggaaagggcgctatggtactggaaggcggcgctttcgtcacgcgtcaaaataaccccagttgcccggtcagtagtgtagcaaaattatcttcaacgaagggaagaattccttccgccacgggttgtagctggcgggtaagatagtgttcgtaatccagcggcgactgctggtaatccacgggctcggggccgttaacagtccagacatattttatggcgccgcgattctgatactgcgccggacgaccctgcttcaggttttgttcatccgccagccgggcggcgcgaacgtgcggcggaacgttacgttggtactcatgtaaagggcgacgcagacgcttacgataaaccagctgtgcgtccagttcgcccgccatcagtttatcgatagtctcgcgcacatagtcttgataaggttcattgcgaaaaacacgcagatacagctcctgttgaaagcgctgcgccagcggcgtccagtcggtccgcaccgtttccagacctttaaataccatgcgctggctgtcgccttcctgaatcaggcccgcgtagcgttttttactgccagtatccgcgccgcggatggtcggcatcagaaaacggcaaaagtgggtttcaaactccagctccagcgcgctggtcaaattttgctgttgtaacgtctgcgcccaccattcgttcacgtgacgcaccagcctgtgcccgatttccgccgcatcggcttctgaatgcgcgcgccggagccagacgaaagtggaatcggtatcgccataaatcacgtcataaccctgcgcctcaatcagcgctttggtctggcgcataatcgcatgaccgcgcatggtgattgacgacgccagacggggatcgaaaaagcgacaggccgtggtgccgagtacgccataaaaggcgttcataatgattttaagcgcctgcgagagcggtttattaccctgacgtttggcttcatcgcgcccgtgccagatttggctaacaatttccggcaggcagtgcttttctcgtgaaaaccaggcgtcaaggaaaccttcggtactgtgttccggatccggctgcgccatgccttcgaccagcccgacgggatcaatcaaaaacgtgcggataatcgacgggtacaggcttttataatccagcaccagtactgaatcgtataatccgggttgtgaatccattacgtagccgccgggacttgccagcggcggcacttcgccgagattgggcgcgacatagccggcgcggtgcattcgcggaaagtaaagatgcccgaatgcggcgaccgaaccgccgtggcgatcgaccggcaggccgttgatcgtcgcgcgttccagcaaaaacggcatgatctcggttttatggaaaatgcgcgtgaccagctcgcagtctttcaggttgtaggtggcgagggcgggtttatcctgggcaaagcggcgatcgatctcatccatacgatcccaggggttatcaatggattttccttcgccgagcagttcctgcgagacggcttccagcgaaaaagacgaaaaattccagaacgcggatttaagcgcgtcgataccatcgataatgactcgccctctggcctgggcgaaaaaaacgccgtttttgaagccatgttcgcgccactccagttcgctattgtctcgccccagccgtaaagggatacggtagcgttcggcatgtttttgcagcatacgcaggtcgaactgcactacgttccagccgatgatgacatcaggatcatgttcggcaaaccaggcgttgagtttttccagcagctgcgggcggctggcgacatacacaagctcgaagtccagttggtggtcatcgccattcgccgggcccagcatataaacggtacgctggccgcagccttccagaccaatgcaatacagttcgccgtgtcgcgtggtttcgatatccagcgagacccattttagcggcggtcgatagtcggagtggggtttaagacgcgcattgcggataacgccgttgcgcatctcgccgtctacccaaacgggcgacgtaataaaacgctccatcaggtaacgttccggcgggcgtacatccgcttcataaacggtgacgccgttttcgcgcagcagtttctccatccgcataagctggcggtgagtgcggcaatacagaccggataccggctgacgatgaaagtctcgcagctggagcggcgtcaggcgatagtctttttccgcctgtagcagcgaggcggcgcgggaggtctggctggtcggaataaacgccacggactcttgcggcgccagcgttgcctgcacagggccgttgtctgtcgccagccagaaagagacctccgtcccttgcggcgtatcccgccagtgccgggttaaaatgaaacctgcctgcgccacgatgattacctgtctaaaaaattcacgctaattataacctgttttagggggtaatactgttattttgtacaggcatataacgtaaaagccgatatccgctgtaataaaaagtttctcgcagtaagaagcgggtttgcgcccaccaggatttatagcgggtggatcgcgtgggtgatgagcggctatcgataccattatcctgagcgatagttttcagacgcagcatatgcagcggatcgctgaccagtaacgctgtgcgccattgttgttgtcgcagtatctgttttgcgtaacgaatattttcgcgcgtcacggtagagcgctcttcaataaaaattgccttagccggaatccctttttccagaacgtattgacgggctatcgccgcgtcggaaaccgttgcgccagcgccgtagccgccggttaataccaacgcgcggacaatgtgttgttggtaaagccagatggcatgatccagtctggcctgaaaaacgggagaaggcgtttttccgctaacgcctgctcctgcgacaatcgcgcagtcagctacgcgcgtctggttttgctgactgaactgataaatagcgatggcattatggataaacaccgtagccataatgagaattatgcctgccgcgattctgatgatgtagcgatatttcatgaatgagttcgttccccgtgacgggtgtaatggatattttaacgataaaatggcttttagcgtcagatatttttgctgacgtatatttatcaatatatacccaaaataattcgagttgcttaaaggcggcaagggagtgagtccccaggagcatagataactatgtgactggggtgagcgacaaatctgccgggagcagatttgaacgtcgcgtgcgacggcccgtcagggcaaggcccatggatgggccgagtaatccgtagccaacacataagcaactcgaagtatgaagggtataatgatgctggtgtagacagcagatataattatcctataactgctaattttgaatcatttttatttacagtttttacccatgtattagccgttttgtgtcaagtctgttttcatacattaagtatttttcagaaaggcgcttgttcgaatctgttacttatttctcggattaacaaaaaagcgatattttttgtttgttttaattaatgaaaagtgtaacaatttcatttggaacatccgcaccgtcaggtagaaatataatattccaattggccgctatggttaaataaaaatggattacagtgcgaattcgtcgggaactctctgcataatttaatttttattttagaatataattttattttgactttcgggtgcgggtgtttttatcaaaatttgtggtattcgggaatgatcttttatgaatgtgagtatgcaggcgcgtctggtagggaacgaccgttatcttttcgtcaatactcaacgcgctaacccttccataaaaaccgtgagtcgattttttgagtataaaacatggacagaacagatttggcgtaccgagattattgaaaacggcaatgctttttttcactggcaaggacacgacagaaaaaacggacatcgggataccattattaactatctgttaaatgggcaacgctggcagtcaacaatcgaagattatattttcttccatgcgctggaaggaaaagcgtggcagggacattatgacaatattattgaatatgtgagttctgatcattacgtctatcaaagcgcatttgctgaatatatcaccgaccagattcatcaacgcgccccccatgggacgcgtttttagaggcattactgcccgtaataggcttttgcgccgtgtttgcgtagatagtgtttatccagcagggattgctgcatgtcgggcaactgcggcgcaagctggcggcagaagatccccatataggccacttcttccagcacgatggcgttatgcactgcatcctcggcatttttaccccaggcaaacgggccgtgcgaatggacaagcacgccgggcatttgagcggcgtcaatgccttgtttttcaaaggtttcaacaatgacattgcccgtttcccattcatactcgccattaatttccgcctcggtcattttgcgagtgcagggaatcgtaccgtagaaatagtcggcatgggtggttcccgtcgccggaattggctgacccgcctgcgcccagatagtcgcgtggcgcgaatgggtgtgtacgatgccgccgatagtcggaaatgcctggtacaacagacggtgggttggcgtatcggacgacggtttcttatgaccttcaacgacttcaccgctctccaggctgaccaccaccatatcgtcagcggtcatgacgctataatcgacgccggacggcttaatcaccagtacgccgcgttcgcgatcgacggcgctaacgttaccccaggtaagggtgaccaggttgtgttttggcagcgccagattagcttccagtacctggcgtttgagatcttctaacattgttttctccctgccggatggcgcttcgcttatccggcctacgagcgacggtgtgccggatggcgacataaatgccttattcggcctacaggaccgtaggcccggtaaacgcagtgccaccgggcaatccgtttcaccaattaacgtttgaacccgtaatacacctcgttccagcgcagcgcgtccttaaaggccggcagatgggtatcgttatcaatcaccgcgatttcgatatcgtgtatttctgcaaactggcgcatatcgttcagatccagcgcgtggctgaagacggtatggtgcgcgccgccagccagaatccacgcttcggaggcggtcggcagatccggctgcgccttccacagcgcgttagccaccggcagtttcggcagggagtgcggcgtttttacggtgtcaatgcagttgaccagcaggcgataacgatcgccgaggtcgatcaggctggcgacgatcgccgggccggtttgggtattgaaaatcaaacgcgccggatcttccttgccgccaatgccgaggtgctggacgtcgaggatcggtttctcttccaccgcgatggacggacacacttccagcatgtgcgagccgagcaccagatcgttgcctttctcgaagtggtaggtgtaatcctccataaatgaggtgccgccctgcagaccggttgacatcactttcataatgcgaagcagagcggcggttttccagtcgccttcgcccgcaaagccgtagccttgctgcatcagacgctgtacggccagacccggaagctgtttcagaccgtgtaaatcttcaaaggtagtagtgaatgcgtggaagccgccctgttccaggaaacgcttcataccgagttcaatacgcgccgcctcccgcacgttctggcgtttatcgccgtggatttgggtggcgggcgtcagggtatagctgctttcatactcgtcaatcagagcgttgatatcgccgtcgccgatagaattcaccacctgcaccagatcgccgaccgcccaggtattgaccgaaaagccaaatttgatttgcgcggccactttatcaccgtcagtcactgcgacttcacgcatattgtcgccgaagcggcagacttttagctggcgggtatcctgtttagagaccgcctggcgcatccaggcaccgatacgcgtatgggcctctttatcctgccagtgaccggtgacgaccgcgtgctgctggcgcatccgcgcgccgataaaaccgaactcacgaccgccgtgcgcagtctggttcaggttcataaagtccatatcaatgctgtcccacggcagggcggcgttaaattgggtatggaattgcagtagtggtttgttaaggatactcagcccgttgatccacattttggccggggagaaggtgtgcagccagaccaccagccctgcgcagcgatcgtcataattggcgtcacgacaaatggcggtaatctcatccggcgaggtgcccagcggttttaataccagtttacatggcagtttggcttcggtattcagcgcgttgaccacatgctcggcatgttgggtgacctgacgcagggtttctgcgccatacaaatgctggctgccaatcacaaaccatacttcataattatcaaaaatcgtcattgtcgtgtccttaatgagtcaggattgcctgattggccggggtcgttggcgccggcgcggcagtcggaagataatgttgttctgcgcttagcgcccactgctggtagcggcggtaaagctgttcgaagcgttgcgcctgttcagggtgggggcgcagagtgcgttctaccgcgctcgccatgctttgctgggcggctggaatgtcggcatggactttcgcagcgacggcggcaaagatagcggcgcctaatgcgcaacactggtcggaagcgacgatctgcaacggacgattcagtacgtcgcagcagacctgcataatgacctgatttttacgggcgatgccgccaagcgccatcacgttattgaccgcgataccctgatcggtaaaacactcctgaatggcgcgcgcgccgaaggcggtcgaagcgaccagaccgccaaacagcgctggcgcgtcggtggcgagattgagatcggtaatgacgcctttcagacgctgattagcgtttggcgtgcggcgaccgttaaaccagtcgagcaccaccggcaggtgatccagggacggatttttcgcccaggcgtcggtgagcgctggcagtagctgcttctggctggcgttaatctggggtttcagttccgggtgctgcgcggcaagttgctccagcggccagctcaacacgcggctaaaccaggcgtagatatcgccgaaagcagattgccccgcttccagaccgataaagttcggcaccacgctgccgtcaacctgaccgcaaatgcctttcacggcgcgatccccgacgctctgtttatccgcaatcagaatgtcgcaggtagacgtgccgatgactttcaccagcgtattgggctgtgcgcccgcgccgaccgcgcccatgtgacagtcgaacgcgccgccggaaatcactacgctttccggcaagtcgaggcgctgcgcccattcggcgcacagggtgcccacgggcagatcggcggtgaaggtttcgctaaataacgggtagcgcagatgacggttaatgcacggatcgagttcatcaaagaagctcgcgggcggcagaccgccccagctttcatgccacagcgttttgtgcccggcgctgcagcggccacggcggatatcctgcgggcgagtggtgccggaaagcagcgccggcacccagtcgcacagctcaatccacgagacggcggcctgcgcgacggcgctatcctgccgggtgacgtgcagaatcttcgcccagaaccattcgctggagtaaatgccgccaatatagcgggagtagtcgaccttgcctggcttatggcacagacgagtgatttcgtcggcctcttccacggcggtgtgatctttccacagcacaaacatcgcattcgggttctcggcgaactctggacgcagcgccaggacgttaccgtcggcgtcaatcggcgctggcgtagagccggtgctgtcaacgccaatgccaacgacatttgcgcgttgcgcggcgcttaattgtgccagaacggctttcagcgcggcctccattgactccatgtagtcgcgcggatgatgacggaactggttgttcgggccgtcgcaataacggccttcttgccagcgcggataccactctacgctggtggcgatctcgtcgccggtggcgcagtccactgccagagcgcgcactgaatcactgccaaaatcgaggccaattgcaattgccatcgtcttactccatccagaaaaacaggtatggagaaacagtagagagtcgcggcaaaaaccgtcaggcaggatccgctaatcttatggacaaaaatgctaatgctttgcaaagtgtgacgctgtgcaaatattcaatgtggacattccagccatagttatagacacttctgttacttaattttatcgcctgaactgtacgcttttgttacaaagcgcttttcacaagcggggttgatacgtgctttcatcaagcgcaaagtcttgcggagacggaagctctgtcgtcctggtcgatatggacaatttgtttcttctctgaacatcggggggtagagaaatcatggctgaaacgcaaaatgatccgctattgccgggatattcatttaatgcccatctggtcgccgggctgacgccaattgaagcgaatggatatctggatttttttatcgatcgtccgttgggcatgaagggatatattcttaacctgaccatccgcggagagggcgtcattaataataatggcgagcagtttgtctgtcggcctggcgatatattattgtttccgccgggcgagattcatcactatggacggcatccggacgccagcgagtggtatcaccagtgggtttatttccggcctcgcgcctactggcaggagtggctgacctggccgacaatctttgcccagacaggatttttccgcccggacgaggcgcgccagccgcatttcagcgaactgttcgggcagatcatcagcgccgggcaaggggaaggtcgctattctgagctactggcgatcaatctgctggagcagttgttgctcagacgtatggcggtaattaatgagtcgttgcacccgccgatggatagccgtgtgcgcgatgcctgccagtatatcagcgaccatctggcggacagccattttgatatcgccagcgtcgcccagcatgtctgcctgtcgccctcccggttatcacatctgttccgccagcagttaggcattagcgtattgagctggcgcgaagatcagcgtatcagccaggcgaaacttctgcttagcactacgcgaatgccgatagcgaccgttgggcgcaatgttggatttgacgatcagctctatttttcgcgggtatttaaaaaatgcaccggggcaagtcctagcgagttcagggccggatgtgaataaaaagtgaatgatgtgtccacaaagatgtcataagccgtaactattcggataattgacggcttgacgaagggggacggggtaagcagaatccctgcttcatcacgctgacggacacactatgcaagcactgctggaacactttatcacccaatccactctgtattcgctcatcgccgtgttgctggtcgccttcctggaatcgctggcgctggtggggttgattttacccggcacggtactgatggcggggctgggcgcgcttatcggcagcggcgagctcaatttttggcatgcctggctggtgggtattatcggctgtctgatgggcgactggatttcgttctggctggggtggcgctttaaaaagccgctacaccgctggtcttttatgaaaaagaacaagtcgctgctggataaaaccgaacacgcgctgcatcagcacagtatgttcacgatcctggtcggacgttttgtcggtccgacgaggccgctggtgccgatggtggcagggatgctggatcttcccgtggcgaaatttattgggccgaacttgattggctgtttgctgtggccgccgttttatttcctgccgggcattctggcgggagcggcaatcgatattccttccgatatgcagagcggagatttcaaatggctgctgctggcgacggcgttgctgctgtgggtcggaggctggctatgctggcggctgtggcgcagcggcaaagcggcagtcgatcgtttaaccgcgtatttcccccgcagccgtttgctgtatctggcgccgttgacgctcgggatcggcgtggtcgcgctggtggtgctggttcgccacccgctgatgccggtatatatcgatattctgcgcaaagttgtgggttactaacgattcctttgccggatggcagcttcgccttatccggcctacaaaatatgggatttgatgcccaatagcgctgaggcgctggcttgaccgcttagtagctcgtctgttttgccttgccacgcgatacgcccgtcggccacgacgattgaccggggcgcaattcgcgccgcatcttccacgctgtgcgagaccatcaacagcgtgagctgtcgctcgcggcagatatcgctgaccaacgtcagcatctcctggcgcagcgcgggatcgagcgcggagaacggttcatccagcagcagtaccggctgttcgcgtaccaggcagcgcgccagcgctacccgctgacgctggccgccggacagttcgcccggtaaacgcgtcatcagactctcaatgcccatctgatgtgcgatagcgtcccgtttttcccgctggctggcgttgagcgttaacccagggtttagccccagaccgatattttgctgcacattcaggtggctgaataaattattctcctgaaacagcattgagaccggacggcgtgagggcggcgtaagcgtatgatcgtcgccggcaatcagtagcgtaccgctggcaggcgcaagaaaaccggcaattaaattcaacaacgtgcttttccccgcgccgctggggccaagaatcgccacctgctcgccgcgttctaccgccagcgtaaaacgcatcggcaaatgatggtaaagccaggtgatatcaatcagttttagcatgtcggcccggtagtttctctatgagggtaaataacgtaaagcagagcagcagcagtatcagcgcggtcactgcgccgtcctggctgcggtaggagccgatctgctgatacagataaaacggcagcgtgcggaaattgtcattgccgaaaagcgcgacgacgccaaaatcaccgatagaaagtacgcaggcaaacgccagcgcctgcgccagcggacgtttcagcgcccgcagttccacgatctttaaccgcgaccagccttcaattcctaatgactggcacagcattccataacgggcggtaatatcgcgcattgggttttccaggacttttagcgcgtaggggattgccatcagcgcattggtgaaaatcacgatgccgtcggcggattccggtaagccaacgctgttattgagcagtaaaaagaagcctgtcgccagcacgatccccggcatcgcgaggatcaacattccgctgagttccagcgtttgtccggcgaatagttgctggcgttggcgtagctcgcggctactccacagcagcatcatggtcagcaccacacacagaacgcccgccgccagcgcaatgcgtagcgatgtccagacagcctgccacagaatgggttgcgccagcacctccggcaggctgcggttgacgccatcgaccaccacggcgaccagcggcggaagcagcagcagcagcgccagcacgattaataaggcgtccgtcagacggctgtggagacgatcgtcaggatcgcgccagccctgcgtcagcgtcatccccggcgcaatcgctttgctcaaccgttggcttagcagtaccagcgccaggcagcagaccatctggattaatgccagcatcgccgcgcgggcgggatcgtagtcataactgagcgcctgaaagatagccagttcgatagtggtggcctgcgggccgccgccgagcgacagaaccgttgcgaaactggcgaagcagagcataaaaatcagcgccgcgacaggcggaatttggcggcgcagccacggccattcgacaaaacggaaaaaatgccagccgcgcataccgagctgggcggcgagctggcgctgctcgccgggaatgctttccaaagattgcagcaacaaacggctcgccattggcaggttaaaaaagacgtgcgccagtaaaatgccctgcaagccgtagggggagaatgtccactgaagccccagcatctgccacagcgaggccagccagccctgacggccatacacgctaagaatgccgaacacggcaaccagtaccggcagaatcagcgtcatggcgcacagacgcagcagcgccagacgtccaggaaaacggcgtcgataaagcgcgcgggcgagaaaaaccgccgggaccacagacagcactgcggacagaaacgcctgccagaatgagaagcgcaccacatgccacaggtagctatcccgccagattgtcgaccacgcgcccgacggcgcattcagccaaagcgccagaaaggccgccagcgagacggttatcatcagcgcggcggcgcacagccccggaatcagccagccgggaattaacggctgacggcgcgttgccattcgctaatccatgcctggcgttgtgctgccacttgttgcggcgtgaattccagcgttgtggcgggtttggccaatgattcaaaccctgcgggtaaggcgacgtccgctaccgggtacatccagttgccggtgggtatggcgttctgaaacgccggagaaaccataaatttgaggaatttctccgccagttccggctgcttactggcgacggtacgcgccgcgacttctacctgtaagtaatggccttcgctgaagttcgcggcggcgtaattgtccttcttctcttcaataatgtgatacgccggagaggtggtgtaactgagcaccaaatcgctttcacctttcagaaataaaccgtaggcctcgctccagcctttcgtcaccgtcaccgttttggccgccagtttttgccaggcctgcggcgcgttatcgccatagactttgcgcatccacagtaacagccccagccctggcgtactggtacgtgggtcctgataaatcacccgccatttttgatcgctctcgaccagttctttcaggcttttcggcggatttttcagcttgcttttatcgtagacaaaggcgaaatagccgtaatcgaatggcacaaatgtgtcgtttttccagccgccgggcaccttgaccgcttcattcgccacgccgcttttggcaaagagtttagtttgcgtggccgcttccagcagattgttgtccagccccaacaccacatcggctttgctgttcttcccctccatccgcaggcggttgagcagcgaaacgccatcctccagcgccaccagtttcagctcgcagttgcaatcggcttcaaacgcttttttcaccgccgggcctggcccccagtcggcggcgaacgagtcgtaggtatagacggtgagaacgggtttggcgaaagcaggcgccgcgcacaggagtaaaagtggaagatatttttttaacactttgcacctcagttaaagagtggcaaaggacttgagaggtagcctcaaatcccttcgccggcattatccggatcaggttcgacgggtattttctcagcgcgcgcatgagcgcggcaccccgttgagttcggcgttagtgtagtgattttgttgccgggcagcaatcaagagctggcgttaaggatctggcggcgcaaaccacgccgatttaaaatcaaaccagccgagggtattcatgcgcagcccgcgcatactgcgctgtccctggataatcagccagtggtggatcaacggcacaatcgctttgttggccagcagttgctggcaccagttcgccaggttcatctcgccagcgcgccactgcgcggcgtcgccctgccagtcgcgcggaatgcagttctgcaagagcggtacttcgcacaagtgcgcgaacagcgagaaatccagcggcagcgtaaagttagcgctattgagccagatatcgctttcgatctcgccggcgtgccattgatcgtagtcgatctcctgaatatgcagatgcacctgatgttcagccagaagcgcgctcatgatacgggcgataacccggtgctcaatgtgttcgcgatagaaggtcagcgtgagggtttccagcccggcgggtttttcgcccgggcctggacgggcgtgatgccagcgcggtaaaagcccataggccgggaaccagagctgctgtagcggttcatcggcatgatagagtaaattggtgggggagaggacgtggcttacccattctctgacctgcggatgtgcgccgcgcggcgttctggcgtcgaatagcaggtaatagcacccctcttccagtcggctttctatcgctttttcaccgccttgtatcggcccttccagcatcaagccgcaggccggttcttcactgatatccggcagtacccagacgttcacttcgtctatcaacgcccgatagccgaagtaatcatcaaaggcgagtatcttgagctggtttggcgtattacgccgcacggcataaggcccggtgccgatagggtggctggcgaaattagccagcgtttcccacttccgcggcaaaatcatcgccgggacctggcccagcagccacggcaaccagcgatccggctgggaaagatgaatatccagcgtccacgcggtaggggagtctatctttgtgatgtgcgagtaaagcggaagcgtattgatacgcgtcagcgaggagatgacatcttccatctccagctcgcggccatgatgaaaatgaatgccggggcgcaggtagaagcgccacagtaaaggggaaatttgctgccagtggtgcgcaatgtccgcttccagttccccgttttcctcatttacccgcgtgagcgaactgaaaatttgccgggcaatatgagtttccgagcgacgtaatgcggttcccggcagaagattgtgcatcggacgatagtaaagaacccgcagaatatgccgcccctggcggaagctgcgtcccagatgggaaatcagcatttgcctgacagcgcttttatcgccgaccagttgtaccagttgatcgattcgatcttgttccagcaggtcttccgcccgctgctgttgcagcgccagtccggtatacaggaacgtcagacgcgaacgctttccgcgtccaacctcggcttcccatgttagccaaccgcgcgcctgcatcgtatttagcagcgtacgcatatggcgacgcgaacagttcagcagatccgccagctcattaagcgtggtgtcttgcgttttaccgtcacaacattgccagagacggataaattgttgttgcaggcgacctgagggcataaaaggggaactccgatgaaaaactcagcaattttattatccctatattaggccaataatatctttcgatgaagcaagaggaagaggtcactatgcgccagttctggttgagatattttgccgcgacggaaaaaacgtcctggctggcttgcctgagcgcaccgcagcgcttaaaaatgctcgcggaactgatgcagtgggaggcgaccgattgaagccaattgcagacatcatgtgtgactgagtattggtgtaggcgatagcctaaaatcacccgccagcagataatatctgctggctttttttatttcggctgtttctggatgacgatgatgggacggcgtttcaacgggatttatacggcggtttctgtggtcacgcaggtggtgaccgggcgagtaaaaatcgtataaaaaatgccggaatatccccggcatgagcgactgatgagtaacccggagcttgatggcgctacgcttatcaggcctacagaatataatggcaaccgggtgatattgcataacctgtaggcccggtaaggcgtcaagggttaccgcataaatgccggttgtttattttcgtaggcggcaatcgcgtcttcgtgctgcagcgtcagcccaatgctgtccagaccgttcaacatgcagtggcggcggaagtcgtcgattttaaagctgtaggttttatcgcctgctttcaccacctgtgcttccagatccacttcaaatttaatgcccggattggctttcaccagggcaaacagctcatcgacctgtgcgtcgctcagggttaccggcagcagttgattattgaaactgttgccgtagaagatgtcggcgaagcttggcgcgatcaccactttaaagccgtaatcggtcaacgcccacggcgcgtgctcgcgtgacgagccgcagccaaagttttcccgcgccaacagtatcgacgcgccttgatattccggaaagttcaacacgaattccggatttggctgttggcccttttcgtccaggaaacgccagtcgttaaacagatgggcgccaaaaccggtgcgcgtaaccttctgcaaaaactgtttagggataattgcatcggtatcgacgttggcggcatccagtgggacaaccaggccggtatgctgggtaaatttctctgccatggtagtttccttatttgatgctgcgaatgtcggcgaagtggccggtaacggcggcagcggcggccatcgccgggctgactaaatgcgtgcgacccccgcggccctgacgaccttcaaagttacggttgctggtggaggcgcagcgctcgcccgggttcaggcggtcgttattcatggccaggcacatggaacagcccggtaagcgccattcaaatcctgcttcgataaagatcttgtccagaccttccgcttccgcctgcgctttcaccggacctgaacccggcaccaccagcgcctgcacgcccggcgcaactttgcgccctttggcgacttccgccgccgcgcgcaaatcttcaatgcgtgaattggtacaagagccgataaagactttatcgatagcaacgtccgttaacggtacgcccggctgtaagcccatataagccagcgctttttcggcgctggcgcgctcaaccggatcgctaaaggaggcgggatcggggatgatgtcggtgacggaaatcacctggcccggattcgtgccccaggtcacctgcggcgcgatctcttctgctcgcagggcgacgacagtatcaaaggtcgcgccgtcatcggttttcagcgttttccagtactcgacggcttcgtcaaaatcgcggcccttcggcgcgtgcaaacgcccttttacgtagttgaaagtggtttcatccggggcgaccagaccggctttggcgcccatctcaatcgccatattgcacagcgtcatgcggccttccatactcagcgcgcggatagcgtcgccgcaaaattcaaccacgtgtccggtgccgccggcgctaccggttttaccgatgatcgccagcacgatgtctttggcggtaatgcccggcgcggcgttgcccgtgacttcaatcttcatggttttagcgcgtccctgtttcagggtttgcgtcgccagtacatgttctacctcagaagtgccgatgccgaaggccagcgcaccaaacgcgccgtgggtggcggtgtgggagtcgccgcagacgatggtcatgcccggcagggtgacgccctgttccggccccatcacatggacgatgccctgatatgggtgattcaggtcatacagctcgacgccgaactcgttacagttcttaatcagctcctgcatctggatacgcgccatttcaccggaagcattaatgtctttagtctgcgtcgagacgttgtgatccatcgtagcgaaggttttccctggctgacgtaccggacgatggtgcgcgcgcagaccgtcaaacgcctgcggagaggtgacttcatgcaccaggtggcggtcgatgtacagcagcggcgtttcgtttggcgcctcaaagaccacgtgggcatcaaataatttttcgtataacgttttggccatgattacaccccttctgcgacatagcgggcgataatatcgcccatctcatcggtactgactgcggcagcgcccctggctaaatcgccggtgcgaacgccctcttctaatgcgcgattgatcgcctgttcaatggccgttgccgcatcgttggcatccaggctgtagcgcagcagcagcgccagtgacaggatctgcgcaattgggttggcgatatttttcccggcgatatccggcgcggagccgccagccggttcatacaggccaaacccttgctcgttcaggctggcggagggcaacatccccattgagccggtgatcatggcgcattcgtcggacagaatgtcgccgaacaggttagagcacagcagtacgtcaaactgcgacgggtctttaatcaactgcatggtggcgttatcgatatacatgtgcgcgagttccacatcgggatacgttttcgcgacatcattgacgatttcacgccacaggatagagctttgcagtacgttggctttatcaatagaggtgactttacggcggcgtttacgcgccgattcaaaggcgatacgggcaatgcgctcgatctcaaagcggtgataaacttcggtatcaaaggctttttcgtactgaccgctgccttcacggccttttggctgtccgaaatagatcccgccggtcagctcgcgcacgcacaggatatcgaaaccgttagcggcgatatcggcgcgcaacgggcaaaatgcttccagtccctgatacagtttcgccggacgcaggttactgaataatttgaaatgtttgcgcagcggcagcagggcgccgcgctccggctggctttccgggggcaaattttcccatttcgggccgccgacggagccaaacagaatggcatccgcctgctcgcacccttcaacggtggctttcggcagtggatgaccatgattgtcgatagcaataccgccgacgtcatagtggctggtggttatacgcatatcaaaacggctgcgtaccgcatccataactttcagggcttgcgccatgacttccgggccgataccgtcgcccggcagtacggcaatatgatagttcttcgacattacacggtttccttgttgttctctttattttgagctttgcgttgcaattctttttcaacttcggcggcgcgccagatattgttcagtacgtgcaccatcgctttggcggaggattcgacgatatccgtcgccagcccgacgccgtggaagcggcgaccatgatggttcacgacgatatcgacctgacccagcgcgtctttgccctggcctttggcgttcaggtcgtatttaaccaactcaacgtcgtagccagtgatgcggttaatcgcctgatagatggcgtcgaccggaccgttgccgttcgccgcttcggccttgatctcttcaccacaggccagcttcacggaagcggtggcgatatcgctggagccggactgcacgctgaagtaatccagacggaaatgctctggttcttcttgctgtttattaataaacgccagcgcttccaggtcatagtcgaacacctggccttttttgtccgccagcttcaggaacgcgtcgtacaggtggtccatgttgtagtctgtgtccttgtaacccatctcttccatgcgatgtttcacggcggcacggccagagcgggaggtcaggttcagctgtatctggttcagaccgatggactctggcgtcatgatttcatagttttcgcggttcttgaggacgccatcctggtggatgccggaagagtgggcgaaagcgccgctgccgacaatcgctttgttggctgggatcggcatgttacagatctggctgacggtctggctggtgcgccagatttcgtggtgattgatgttggtgtgtacgttcatgatgtctttgcgcactttaatcgccatgatcacttcttccagtgcgcagttaccggcacgttctccgataccgttcatcgcgccttcaacctgacgcgcgcccgcatgtactgccgccagcgagttgcctactgctatccctaaatcgtcgtgggtatgaacggagatgatagctttgtcgatattggggacacgttcatacaggccggaaatgattcccgcaaactcaaacggcatggtatagcccacggtatcgggaatattaatggttctcgcgccggcgtttatagcggcttccaccacgcgcgccagatcgtcaacaggcgtccggccagcatcttcgcaggagaactctacgtcatcagtgtaattacgcgcccgcttaaccatgtataccgcgcgttcgataacctcatccagcgtgctgcgcagcttggtggcgatgtgcattggcgaggtggcgataaaagtatggatgcgaaacgcgtcggcgaccttcagcgcctgtgccgcgacgtcgatgtctttttctacacaacgcgccagggcgcaaacgcggctgtttttaatggtgcgggcgatggtttggacggattcaaaatcacccggagaagagaccgggaagcctacttccatgacatcaacacccatgcgctcaagggccagggcaatctgcagcttctctttcgcgctcaggctggcctgtaacgcttgttcgccgtcgcgtaaggtcgtatcaaaaataatgacttgctggctcatgatgtggtccttgtctccaggggcgccttgcgtcaggcataaaaaaacccgcgcaacggcgcgggttttgtttgacttcgagctgacttaatgttgaatgccgcccaccggtctaccgcgcacaataaatgcgttgagtagtagtagcccagtgaaacgaacgatatgtgacattaattcagctccagcgaatgcgttatgcttttagtggtactggatatgccgtttaatgtcaactctattttctgtcgccattgcattttgttgacgatatccggatacgtactttagctaattgtgctgggctgcgcgtccaataaaggataaaagaacgagtggacattcatacttttcattgtttgaaatatttaggcatttttgtttgcaaattggttaggggaatggcctgttaaaggtatgctaaaggtttggtttatctttttgatttgttttatattttaacaaataaccttgtttgcttaatggataaggataaagttattgataaattaatgttaactttttagctattaataatataaacatttaattgaaacttaaatgatcattcacttggtgtatgattgtgtattcgccatagttatggttatattgcttgcgtaatttaaacattatgaatcgcaatggtgtgactcaggacacattacgcttgcgctggcattctatttgtctctgtcagcgtctttatgttttccgaattttaacgctttccctttttcttattttatatgcatggtaaatcatattttcaggaattatttctgccttcagccagaaaaagggagttaagcgtgacagtggagttaaatatgccagaggtcaaaaccgaaaagccgcatcttttagatatgggcaaaccacagcttcgcatggttgatttgaacctattgaccgtgttcgatgcggtaatgcaagagcagaatattacgcgcgccgcccacacgctgggaatgtcgcagcctgcggtcagtaacgccgtagcgcgtctgaaggttatgtttaatgacgaactttttgttcgatatggacgaggaattcagccgactgcccgtgcatttcagttatttggttcagtccgtcaggcgttgcaattggtgcaaaatgaattgccgggatcggggtttgagccgaccagcagcgaacgtgtattcaatctttgcgtgtgcagtccgctggataatatcctgacgtcacagatttataatcgtgtagaaaaaattgcgccaaatattcatgtcgtttttaaagcgtcgttgaatcagaatactgagcatcagttacgctatcaggaaaccgagttcgttattagttatgaagaattccgtcgtcctgagtttaccagcgtaccgctatttaaagatgaaatggttttagtcgccagccgaaaacacccgcgtattagcggcccgctactggaaggcgatgtttataatgaacaacatgcggttgtttccctcgatcgttatgcgtcatttagtcagccgtggtatgacacgccggataaacagtcgagcgtggcttatcagggcatggcgcttatcagcgttctgaacgtggtttcgcagacgcatttggtcgctattgccccgcgctggctggcggaagagtttgcggaatcgctggatctgcaaatattgccgttgcctttaaaactgaatagccggacatgctacctttcctggcatgaagcggctgggcgtgataaagggcatcaatggatggaagatttattagtctctgtttgtaagcgataaaaccgggcagaataaatcagaaacaaattctggtttattctgctttttagcgtatatcaaaaattttatgctgaattaacggtgagcgatgcttttcgtcgctgtgaaaaatagatgaattgctgtaagtctgcatttataagcgattatttattaccaggtgtgattcagacggagtatttctccatttcttctcttcttgcctcctgattattctaaccttccccatctttacgtcattccacccaattgccaggcgtgatagcgagcggttaaggtgtccgtcaaaccgtgatgacaggtataaagtggaggcaagccgtggaaatgttgtctggagccgagatggtcgtctgatcgcttatcgatcaaggcgtaaagcaggtgttcggctatcctggaggcgcagtgcttgatatttatgatgcgctacataccgttggagggatcgatcatgtgctggtgcgtcatgagcaggccgcggtgcatatggcggatggcctggcgcgagccactggcgacgttggcgtggtgctggtgacttccggaccgggagcgaccaatgcgattaccgggattgctacggcctatatggattccattccgctggtgattctttccggccaggtcgccacctcattgattggctatgatgcctttcaggagtgcgacatggtggggatttcccgaccggtggtcaaacatagcttcctggtcaaacagacggaagatattcccctggtgcttaaaaaggccttctggctggcggcaagcggacgtcctgggccggtggtcgtggatttgccgaaagatattttgaatccggcgaaaaaaatgccgtatgcctggccggagacggtcagtatgcgctcttacaatcccacaacatcaggacataaaggacaaattaagcgtgccttgcaaacgctggcgtcggcaaaaaagccggtggtctacgttgggggaggggcgataagcgcggcctgctatgcgccgttgcgccacatcattgaaacctttaacctgccggtggtctcttcattaatgggactgggcgcgtttcctgctactcatcgccagtcgttaggaatgctgggaatgcatggcacttatgaagccaatatgaccatgcataacgccgacgtgattttcgctgttggcgtacgatttgacgaccgcacgacgaataatctcgctaaatattgtccgaacgcgacggtattacacatcgacattgacccgacgtccatatccaaaacggttaacgctgatatcccggtggtgggcgatgcccgcctggtactggaacaaatgctggagctactggcgcaggatgcgccgtctcagccgcaggatgatattcgcgactggtggcagcagatagagagctggcgcgcccgtcagtgcctgaaatatgacgcggaaagcgaaagcattaaaccccaggcggtgattgaaaccctctggcgtctgacgaagggcgatgcgtacgtgacgtccgatgtaggacaacaccagatgtttgccgccctctattacccgttcgataagccacgtcgctggattaattccggcgggctcggcacgatgggttttggcctaccggctgcgctgggcgttaaaatggccctgccgaaagaaatggtggtctgcgtgaccggcgatggcagtatacagatgaacattcaggagctgtcgacagccttacagtatgaactgccggtactggttttgaacctgaacaaccgttatctggggatggtgaaacagtggcaggatatgatctattccggtcgccattctcagtcttatatgcagtcgttaccggattttgtgcgcctggcggaagcatatggccatgtcgggctgcagattaaccgtccggatgagctggaaagtaaactcagcgaagcccttgagcatgtgcgtaataaccgactggtgttcgtcgatgtcaccgttgatggcagcgagcatgtctatccgatgcagattcgcgggggcgggatggacgaaatgtggttaagcaaaacggagaggacctgatgatgcgccggattttatcggtattactggaaaacgaatctggggcgttatcgcgggttatcggcctcttttcgcaacgcggatataatattgaaagcctgaccgtcgcgccgacagacgatccgacgttgtcgcgcatgactatccagacggtaggcgatgaaaaagtgcttgagcaaattgaaaagcaactgcacaagctggttgatgtgctgcgcgtcagcgagctgggacagggagcgcacgttgagcgggaaatcatgctggtgaaaatccaggccagcggctacggacgggaagaggtgaagcgtaatacggaaattttccgtggtcagattattgacgttacgccaacgctgtataccgttcaactggcgggcaccagcgataaactggatgcttttctggcctcgctgcgcgacgtggcgaaaattgttgaagtggcgcgttcaggcgtcgtcgggctttcgcgcggcgataagattatgcgctgagcagattcgccggatgacgacgcgcgtgcgttttatccggtctactggctgatatctggcccaggtccgataagcgtagcgccatcaggcaggtttgccggatatcagccaacaggaattatcgcccaacccaatatcatcggttgggcttttttttgcgaaatccgtggtaacccggaataaaagcggttgccggagtgatcaaactgcgcttagatgttaacgattttaacccatgccgacataaaggttatggtttgtacaatttacacaaggggcaattgtgaaactggatgaaatcgctcggctggccggtgtctcgcgcacaactgcaagctacgttataaacggtaaagcaaagcaataccgcgtgagcgacaaaaccgtagaaaaagtcatggcggtagtgcgtgagcacaattaccatcctaacgctgtggctgccgggctgcgtgctggacgcacacgttccattggtctggtgatcccggaccttgaaaacacgagctacacccgtatcgcaaactatcttgagcgccaggcacgccagcgtggctaccaactgctgatcgcctgttctgaagatcagccggataacgaaatgcgctgcattgagcaccttttgcaacgccaggtggatgcaatcattgtttcaacttcgttaccgccggagcatcccttctatcagcgctgggccaacgatccgttccccatcgtcgcgctcgaccgcgcgctggatcgcgaacatttcaccagcgtggtcggcgccgatcaggatgatgccgagatgttggcggaagagctgcgtaaattcccggcggaaacggtgctttatttgggcgcgctgccggagttgtccgtcagtttcctgcgcgagcaggggttccgcaccgcatggaaagacgatccgcgggaggtgaatttcttatatgccaacagctatgagcgcgaagccgccgcgcagttgtttgagaaatggctggaaacgcatcctatgccgcaggcgctctttacgacatcgttcgcgctattacagggcgtgatggacgtaacgctgcggcgcgatggaaaactgccttcggatttagcgattgcgaccttcggcgatcatgagctgctggattttctgcaatgcccggtactggcggtggcgcagcgtcatcgtgatgtcgcggaacgcgtgctggagattgtgctggcaagtcttgatgaaccgcgtaaaccgaaacccggcttaacgcgtattcggcgaaacctttatcgtcgcggcattctgagccgtagctaaaggaccggcggtaaaagactctctcttctgccgccgtcaaacaaatgcgtatcagtaaaaatatcccttaaataattaagattattccttaaaattatccgaaaattcttttttattacctttcttttgtccgaaatcgtccacattccactaattaagacgtaacgagtcttttcctttgtattgttttgttacaagcaggcaagaaatcgtcgaattaacagccactttttgtctttggcgcgacagtcgctcgtaggcgctggtatagcaggcaccgcacacgttaaacaggcactgttaacacggtgcaatatgtcctaaaatgccgctcgcgtcgcaaactgacactttatatttttctcggattatattgagtccgttttaaacggcggtgggcctttggtttttttcttacaaatattcataacgttaatttggcttgcacgctgggcggaaattaatcaacgcagatattcgccgtaaacattggcttttttacttaggtaagcgttgtgacttgcttgacaagcttttcctccgctccgtaaactccttcgagtgggaatttgtgggataaagtggtaagaaggggtgagactggcatgttccggggggcaacgttagtcaatctcgacagtaaagggcgcctgaccgtgccgacccgttatcgggagcaactgatcgagagcgctaccggtcaaatggtatgtaccattgacatccatcacccatgcctgctgctttaccccctgcctgaatgggaaattattgagcaaaagttatctcgtctgtcgagcatgaacccggtagaacgtcgcgtacagcgtttactgttgggccatgccagcgaatgtcagatggatggtgcaggtcgattactgatcgcgccagttctgcggcaacatgccggactgacgaaagaagtgatgctggttggacagttcaacaaatttgagctgtgggatgaaacgacctggtatcaacaggtcaaggaagatatcgacgctgaacagtcagctaccgaaacgttatcggagcggctgcaggacttgtctctataagatgatggaaaattttaaacacactacggtactgttggatgaagccgttaatgggctgaatattcgtccggatggtatctatattgatggcacatttggtcgcggcggccactcgcgcctgatcctctcgcaactgggcgaagaggggcgcttgctggcgatcgatcgcgatccgcaggcgatcgccgttgcgcagaccattaatgatcctcgcttctccatcattcatggacctttttccgcgctggctgattatgtagccgagcgcgagcttaccggcaagattgacgggatccttctcgatcttggcgtctcttctccgcagcttgacgatgcggagcgcggtttttcatttatgcgcgacggtccgctggatatgcgaatggacccgacgcgcggccagtctgccgccgagtggttacaaacggcggaggaagcggatatcgcctgggtgctgaaaacattcggcgaggagcgttttgccaaacgtattgctcgcgccattgttgagcgcaatcgcgaacagccgatgacccgcaccaaagagctggcggaagtggttgcggcggcgaccccggtaaaagacaaattcaaacatcccgcgacccgtaccttccaggcggtgcgcatctgggtaaacagtgaactggaggagatagagcaggcgctaaaaagctcgctcagcgtactggccccaggcgggcggctttcaatcatcagtttccactcgctggaagaccgtattgtgaaacgctttatgcgtgagcaaagccgcggtccgcaggtaccggcgggattaccgatgacggaagcgcagctcaaaaaactgggcggtcgtgagttacgagcgttaggcaagttgatgccgggtgaaaaagaggtagctgaaaatcctcgggcccgtagttcagttctgcgtatcgcagagaggacgaacgcatgatcagcagagtgacagaagccctaagcaaagtgaagggatcgataggaagcaacgagcgccatgccttgcctggcgtgatcggtgacgatcttttgcggttcgggaagctgccactctgcttgttcatttgcatcattttaacggcggtgacggtggtcacgacggcgcaccatactcgtttactcaccgcgcagcgtgaacaattggttctggagcgcgatgcattggacattgaatggcgcaacctgatccttgaagaaaatgcgctcggcgatcacagccgggtggagcggatcgcaacggaaaagctgcaaatgcagcatgttgatccgtcccaagaaaatattgtagtgcaaaaataaggataaacgcgacgcatgaaagcagcggcaaaaacgcaaaaatcgaaacgccaggaagaacagaccaacttcatcagttggcgttttgcgttgctgtgcggctgtattttactggcgctggtttttttacttggacgcgcggcgtggctacagattatcgccccggatatgctggtgcgtcagggcgatatgcgttcgctgcgtgttcaggaagtctccacctcacgcggtatgattaccgaccgttccgggcgtccactggcggtcagcgtaccggttaaggcgatctgggccgacccgaaagaagttcatgacgccggcggcatcagcgttggcgatcgctggaaagcgctttctactgcgctcaatattccactcgatcagctctccgcccgtatcaacgccaacccgaaagggcgttttatttatctggcgcgccaggtaaatcctgacatggcggactacatcaaaaaactcaaactgccggggattcatttgcgtgaagagtcccgccgctactacccgtcaggagaagtaaccgctcacctcatcggttttaccaacgtcgacagtcaggggattgaaggcgttgaaaagagctttgataagtggcttaccggtcagcctggcgagcgaatcgtgcgtaaagaccgctatggccgcgtgattgaggatatctcctccactgacagtcaggcagcgcacaatctggcgttaagcattgatgaacgcttacaggcgctggtttaccgcgaactgaacaacgcggtggcgtttaacaaggcggaatccggtagcgcggtgctggtcgatgtcaataccggtgaagtactggcgatggcgaatagcccttcctataaccccaacaaccttgccggtacgccgaaagacgcgatgcgtaaccgtaccatcaccgacgtgtttgaaccgggttctacggttaagccgatggtggtgatgactgcgcttcagcgcggtatcgtcaacgaaaatacggtgttgaataccgttccataccgaattaacggccacgaaattaaagacgtggcgcgctacagcgaattaaccctgaccggggttctacagaagtcgagtaacgtcggtgtatccaaactggcgttagcgatgccgtcctcagcgttagtagatacttactcacgttttgggctaggaaaggcgaccaatttggggttggtcggagaacgcagtggcttatatcctcaaaaacaacggtggtccgacatagagagggccaccttctctttcggctacgggctaatggtaacgccgttacagttagcgcgagtctatgcaaccatcggcagctatggcatttatcgcccgctgtcgattaccaaagttgatccgcctgtacccggcgaacgcatcttccctgaatccaccgtacgcaccgtggtgcatatgatggaaagcgtggcgctgccgggcggcggcggcgtgaaggcagcgattaaaggctaccgtatcgcgattaaaaccggtacggcgaaaaaagtggggccggacggtcgctacatcaacaaatacattgcttacaccgcaggcgtcgcgcctgcgagtcagccgcgcttcgcgctggtggttgtcatcaacgatccgcaggcgggtaaatactacggcggcgccgtttccgcgccggtatttggtgccatcatgggcggcgttctgcgcaccatgaacatcgaaccggacgcgctggcaacgggcgaaaaaaatgaattcgtaattaatcaaggcgagggaacaggtggcagatcgtaatttgcgcgaccttcttgctccgtgggtggctggactacccgcgcgagaactgcgagagatgacgctcgacagccgtgtggctgcggcgggcgatctctttgtggcagtggtgggtcatcaggcggacgggcgtcgatatatcccgcaggcgatagcgcaaggcgtagctgccattattgcagaggcgaaagacgaggcgagcgacggtgagattcgcgaaatgcacggcgtaccagtcgtctatctcagccagctcaatgagcgtttatctgcgctggcgggccgcttttaccatgagccatctgaaaacatgcgtctggtggcggtgaccggcaccaatggcaagaccaccaccacccaactactggcgcagtggagccagttgctcggcgaaaccagcgcagtgatgggaacggtaggcaacggactgttgggtaaagtgatcccgacggagaacacaaccggttccgctgtggatgttcagcatgtgctggccagtctggttgcgcagggcgcgaccttcggcgcgatggaagtctcttctcacggcctggtgcagcatcgcgtggcggcgttgaaatttgccgcctccgtgtttactaatttgagccgcgaccatctcgactatcatggcgatatggcgcattacgaggcggcaaaatggatgctttattccacccaccatcatggtcaggcaatcgtcaacgccgatgatgaagttggacgccgctggctggcgtcgctacccgatgcggtcgcggtatcaatggaagggcatatcaaccctaactgtcacggtcgttggctgaaagcggaggcggtggagtaccacgaccgcggagcgacgattcgttttgcttcaagctggggtgaaggcgaaatcgaaagccgcttgatgggcgcgtttaacgtcagcaacttactgctggcattggcgacgctactggcgctgggctatccgttaacggatttgctgaaaaccgccgcgcgtttgcagccggtttgcgggcgtatggaagtgttcactgcgccaggcaaaccgacggtggtggtggattacgcgcacacgccggatgcgctggaaaaagcgttgcaggcggcgcgtctgcattgcgccggaaaattgtggtgcgtctttggctgtggcggggatcgtgacaaaggtaagcgcccactcatgggggccattgccgaagaattcgcggatatcgtcgtggtgactgacgataacccgcgtaccgaggagccgcgcgccattatcaacgatattctggccggaatgctggacgccgggcaggtcagggtaatggaaggccgcgctgaggcggtaaccaatgccattatgcaggcaaaagacaatgacgtcgtgctgattgcaggtaaagggcacgaggattaccagattgtcggcacgcagcgtcttgattattcagaccgcgtgaccgcagcgcgtttgctgggggtgatcgcatgattagcgtaacgctcagcaaaattgccgatgtccttggcgccgaacaccgcggggcggatctcacgctcgatacggtcattaccgacacacggaaagtgacgccgggatgcctgttcgtggcgctgaaaggggaacgctttgatgcgcatgattttgctgataaagcaaaagcgaacggcgctggcgccctgctggtcagtcgtcctctggatatcgatctcccgcaggtgattgtaaaagacacgcgtcaggcatttggccaactggccgcctgggtacgtatgcaggtaccggcgcgggtggtggcgttaaccggttcgtccggcaaaacctcggtcaaagagatgaccgccgcgattcttagccagtgcggaaatactctgtataccgcaggcaattttaacaacgacatcggcgtgccgataacgctgctgcgcttaaaccatgattatgactatgcggtaatcgagttaggcgctaatcaccagggagaaatcgcctggaccgttagcctgacgcgcccggaagcggcgctggtcaataacctggcggcggcgcatctggaaggcttcggctcgttggccggcgtggcgaaagcgaaaggcgaaatctataccggtttgcctgagaacggtatcgcgattatgaatgccgataataatgactggctgaactggcaaagcattattggcgatcgtctggtgtggcgcttttcgccgaatgcggcaaacagcgactttaccgctgcgaatatccacgtgacgtcacacggtaccgaatttaccctgcaaacgccgatgggcagcattgatgtgctgctgccgttgccggggcggcacaatattgccaacgcgctggcggccgctgctttatcaatggcggtgggggctacgctgacggcgattaaagcagggctggcggcgttaaaagccgtacccgggcgtctgttcccgattcagctaagtgaaaaccaactggtactggatgacgcttataacgccaacgttggttcgatgaccgccgcagtgcaggtcctttctgaaatgcccggctaccgcgtgctggtggtaggcgatatggccgagctgggcgcagaaagcgaagcgtgccacctccaggttggtgaggccgcaaaagcggcgggtattgatcgcgtgttaagcaccggaaaactcagtcaggctatcagccacgccagcggcgtcggcgaacattttgccgataaagccgcgctcattgcgcgtttacacgctctgcttcaggagcaaccaatgatgactattttagtgaaaggatcacgcagcgccgcgatggaagatgtggttcatgcgttacaggagaaaggttcatgttagtttggctggccgagcatttggtcaaatattattccggctttaacgtcttttcttatctgacgtttcgcgccatcgtcagcctgttgaccgcgctgttcatctctttatggatgggcccgcgtatgatcgctcgtctgcaaaaactctcttttggccaggtggtacgtaacgatggcccggaatcgcacttcagtaaacgcggtacgccgacgatgggcggcatcatgatcctgacgtcgattgtgatttccgttctgttatgggcttacccgtctaacccgtacgtctggtgcgtgctggtggtattgatcggctacggcattatcggttttgtcgatgactaccgcaaagtggtgcggaaagataccaaagggctgattgcgcgctggaaatatttctggatgtcggttatcgcgctcggcgtggcctttgcgctttatctcgtcgggaaagacacgcccgcgacccaactggtggtgccgttctttaaagatgttatgccgcaattggggctgttttacattctgctgtcctactttgtcatcgtcggtacgggtaacgccgtgaacctgaccgacgggcttgatggtctggcgattatgccgactgtcttcgttgccgccggctttgcgctggtggcctgggcgaccgggaacatgaacttcgccaattacctgcatattccgtatttacgccatgcgggcgagctggtgattgtctgtacggcgattgtcggcgcgggattaggattcttgtggtttaacacctatccggcgcaggtttttatgggcgatgtcggatcgctggcgttgggcggtgcgttgggcattatcgccgtgctgctgcgtcaggaatttctgctggtgatcatgggcggcgtctttgtggtggaaactctgtcggtcatcctgcaggtgggttcctttaaactacgcggacagcgtattttccgtatggcgcctatccatcaccactatgaactgaaaggctggccggaaccgcgcgtgattgtgcgcttctggattatttcgctgatgctggtgctgattggcctggcaacgctgaaggtacgttaatcatggctgattaccaggacaaaaacgtcgtcattattggtctgggcttaaccggactctcttgcgtggacttttttctcgcccgcggcgtgacgccgcgggtgatggatactcgcgtgacgccgccgggtctggataagctgccgcaagaggttgagcgtcacgttggcggcctgaacgacgagtggctcttagcggcggatttaatcgtcgccagccctggtattgctctggcgcatccctctcttagcgctgccgccagcgctggagtggaaattgtcggcgatatcgaactgttttgccgcgaagcgcaagcgccgattgtggccatcaccggctcgaacggcaaaagcaccgtgaccaccttagtgggcgagatggcgaaagcggcgggcgtcaatgtcggcgttggcggcaatatcggtcttccggcgctgatgctgctggatgccgatcgcgaattgtacgtgctggaattatccagtttccaactggaaactacctcaagtttgcaagcggcggcggcaacggtgctcaacgtcactgaagatcatatggaccggtatccgtttggtttgcaacagtaccgggcggcgaaactgcgcgtctacgagaaggcgaaagtgtgcgtagtgaatgccgatgacgcgttgacgatgccggtacgcggggccgatgaacgctgcgttagctttggcgtcaatatgggcgattatcaccttaatcgtcagcagggcgaaacctggctgcgagtcaaaggcgagaaggtgctgaacgtgaaagagatgaagctttccggtcagcataactataccaatgcgttagcggcgctggcgctggcggatgccgtaggtctgccgcgcgccagcagtttgaaggcgttgacgacatttaccggtctggcgcatcgcttccagctggcgttggagcataacggcgtacgttggatcaacgactcgaaagcgaccaacgtcggcagtaccgaagcggcgctaaacggtttgcatgtggacggtacgctacatctgctgctgggcggcgacggtaagtcggcagacttttctccgctgacacgctatctgaccggcgatcgtatccgcctgtattgctttgggcgcgatggcgcgcagcttgccgcactgcgtccggaaatcgcccaacagactgagacgatggaagaggcgatgcgtttgctggcgccgcgcgttcagccgggtgatatggtgctgctgtcgcccgcttgcgctagcctcgatcagtttaaaaattttgagcaacggggcgatgtctttacccgtctggcgaaggagttaggttgatgcgtttatctctcccccgtctgagaatgccgcgcgtaccaggctttggcctcctggcctggctgtttgcggcgcttaaaggctgggtgatggcttcgcgcgataaagacgccgacagtctgatcatgtatgaccgcacgctgctatggctgaccttcgggctggcggcgattggttttgtcatggtgacgtcggcctccatgccagtcgggcagcgcctggcgaacgatccgtttttgtttgccaaacgtgatgcgctctatatcttcctggcattttgtctggcgatggtcacgctacgtttgcccatgaccttctggcaaaaatacagcacgacgatgctgattgcgtcgatcattatgctgcttatcgtgttggtcgtcgggagctcggttaacggggcgtcgcgctggattgcgctggggccgctgcgtattcagcctgcggagtttaccaagctgtcgctgttctgctacctcgcgaactatctggtgcgtaaggttgatgaggtgcgaaataacctgcgcggctttttaaaaccaatgggcgtgattctggtgctggcggtgttactgctggcgcagcctgacctcgggacggtggtcgtactgtttgtcaccacgctggcgatgctgtttctcgccggggcgaaattatggcagttcatcgccattatcgggatgggcatctcggcggtgattctgttaatcctcgccgaaccgtatcgtattcgtcgcgttacttcgttctggaacccctgggaagatccgttcggcagcggttatcagctgacgcagtcgctgatggcttttggtcgcggtgagatatgggggcaagggctggggaattcggtgcagaaactggagtatttgccggaggcgcacaccgatttcatcttcgccattattggggaagaactgggttatatcggtgtggtattggcgcttttaatggtattcttcgtcgcttttcgcgcgatgtcgattggccgtaaggcattggagattgaccaccgtttttccggatttttagcgtgttctatcggtatctggtttagtttccaggcgctggtaaacgttggcgcggccgcggggatgctgccgaccaaaggtcttacgctgccgctgatcagttatggcgggtcgagtctgttgattatgtcgacggccattatgtttttattacgtattgattatgaaacgcgtctggaaaaagcgcaggcgtttacacgaggttctcgatgagtggtcaaccgaagcggttaatggtgatggcgggcggtaccggcgggcacgtgttcccgggactggccgttgcgcatcatttaatggcccagggctggcaggttcgctggctgggtaccgccgatcgtatggaagcggatttagtgccgaagcatggcatcgacattgactttattcggatctccggtctacgcggtaaaggcgtaaaagcgcttctggcggcgccgctgcggatttttaacgcctggcggcaggcgcgggcgatcatgaagcggtttaagccggatgtcgtgctgggaatgggcggttatgtttccggccccggcggtcttgccgcatggtcattgggtattccggtcgtcttgcatgagcaaaacggtatcgccgggctaaccaatcagtggctggccaaaatcgcgaccacagtgatgcaggcgtttcccggtgcgtttccgaacgcggaagtggtgggtaacccggtgcgtaccgacgtactggcgttgccgttgccgcaggtgcgtctggccggtcgtgacggcccgattcgcgtgttggtggtcggcggttctcagggggcgcgagtcctgaaccagacgatgccgcaggttgccgccagactgggcgatacggttacaatctggcatcaaagcggaaaaggcgcgcagctcacggtagagcaggcatatgccggggcgggacaaccgcagcataaggtaacggaatttatcgatgacatggccgccgcctatgcgtgggcggatgtagtggtatgtcgttccggcgctttaacggtgagcgagatcgccgccgccgggttaccggcgatattcgtgccgtttcagcataaagacaggcagcagtactggaatgcgctgccgttagaaaacgccggcgcagctaagatttttgagcagccgcagtttactgtagaggctgtcgccgacaccctggcggggtggtcgcgcgaggcgttgttaaccatggcggagcgtgcccgcgcggtatccattccggatgctaccgagcgcgtcgccagtgaagttagccgggttgcccggacataatttgtggcggtgccttttgcatcgcagggtttttctaccctcaataatttgggttgcaggcaagccaacgcatctgcaatttgaagtatggcgggtattggagttaatggcgtaaagaatgaatacacaacaactggcaaaactgcgttccatcgtgcccgaaatgcgtcgcgttcggcacattcactttgtcggcatcggtggtgctggtatgggcggtattgccgaagttctggccaatgaagggtatcagatcagtggttccgatttagcgccgaatccggtgacccagcagttgacgagcctgggggcgacgattttctttaaccatcgtccggaaaatgtgcgtgatgccagcgtggtcgtcgtttccagcgcaatttccgcggataacccggaaattgtcgcggcgcatgaagcgcgtattccggttattcgccgtgcggaaatgctggcggaactgatgcgttttcgccacggcatcgccattgccgggacgcacggaaaaaccacaacgaccgcgatggtgtccagtatttatgccgaagcggggctggacccgactttcgtgaatggcggactggtgaaagccgcaggcgttcatgcgcgtctgggccatagtcgttacctgattgccgaggcagatgagagcgacgcgtccttcctgcatttgcagccgatggtcgcgatcgtcaccaacatcgaagccgaccatatggatacctatcatggcgactttgaaaatttaaagcagacgtttattaacttcctgcataacctgccgttctacggtcgcgcggtaatgtgcgtcgatgatccggtcatccgcgagttgctgccgcgggtggggcgtcagaccacgacgtatggctttagcgaggatgctgacgtccgcgtagaagattatcagcagatagggccgcaggggcactttacgctgttgcgccagggaatgccggatctgcatgtcacgttgaatgcgccgggtcgccacaatgccctgaatgccgcggcggcagtggcggtagcgaccgaagaaggcatcgccgatgacgctatcctgcgcgcgctggaaagcttccaggggaccgggcgtcgttttgacttcctcggcgagttcccgcttgagccggtgaatggtaaagccgggacggcgatgctggtggatgactatggtcatcatccgactgaagtagatgccaccattaaagctgcgcgagcagggtggccggataaaaacctggtgatgctgtttcagccgcaccgttacacgcgcacgcgcgatctgtatgacgatttcgccaatgtgctgacccaggtcgatgcgctgctgatgctggacgtttacccggcgggtgaagcgccgattccgggcgcggatagccgttctttatgtcgtacgattcgtaatcggggaaaaattgacccgattctggtttccgatccggctcaggttgcgacaatgttagcgccggtgctgacgggtaacgacttgatattagtgcaaggcgcaggaaatgttggcaaaattgcgcgttacttatctgaaatcaagctgaagccgcaaatccaggaggaagagcaacatggctgataaaatcgcggtcctgttgggcggaacctctgcggagcgggacgtttcgttaaattccggcgcggcagtgttggccgggctacgtgaaggcggcattaatgcgcatcccgtcgatccgcaagaggtcgatgtcgcgcagcttaaagcaatgggctttcagaaggtctttattgcgttgcatggccgtggcggtgaagatggcaccttacagggaatgcttgaactgctcggcctgccttataccggtagcggcgtgatggcctcggcgctttccatggataaactgcgcagtaaattgctgtggcagggcgcaggcttaccggttgcgccgtgggtcgcgctgacgcgcgctgagtttgaaaaaggtcttagcgaagaacaaaaagcgcgaatttcggcgctgggtttaccgctgatcgtcaaacccagccgtgaaggctccagcgtcggtatgacgaaagtagtagaagaaaatgctttacagggtgcgttatcattggcttttcagcatgatgacgaaatactgattgagaaatggctgtgcggtccggaatttacagtggcgatagttggcgaagaaattttaccgtcaattcgtatccaaccggcaggaaccttctatgattatgaggcgaagtatctctctgatgagactcagtatttctgccctgccggtttagatgcgtcccaggaagccgcgctacagtctctcgtcctgcaggcatggaaagctttaggctgcacgggatgggggcgtattgacgtcatgctggacagcgatggtcagttttatctgctggaagccaatacttctccggggatgaccagccatagtctggtgccgatggcggcgcgtcaggcgggaatgagcttctcgcagttagtggtacgaattctggagttggcggactgatatgtcgcaggctgcgctgaacacgcgaaacagtgatgaagagacgccttcttcacgccgcaataatggaacgcgtcttgcaggaattttattcctgctgacggtactgtgcaccgtgtttgttagcgggtgggtcgtgttagggtggatggaagatgcgcagcgtttaccgttatcaaagctggtattaaccggcgagcgtcactacacgcgtaacgatgatatccgtcaggcgatactggctctgggcgcgccgggaaccttcatgacgcaggatgtgaacattatccagagccagattgagcgtttgccgtggattaaacaggccagcgtcagaaaacagtggcctgatgaattgaagattcatctggttgaatatgtgccgattgcgcgttggaatgatcaacatatggtcgatgctgaagggaacaccttcagcgtgccgtcagaccgcatcggcaaacaggttttacccatgttgtatggcccggaaggcagcgcgagtgaagtgttgcagggataccgcgagatggggcaggtgctggctaaggataaattcactctaaaggaagcggcgatgaccgcacgtcgctcctggcaattgacgcttaataacggcattaagctcaatctcggcaggggcgatacgatgaaaaggttggctcgctttgtagaactctatccggttttacagcagcaggcgcaaaccgatggcaaacggattagctacgttgatttgcgttatgactcaggtgcggcagttggctgggcgccgctcccccctgaggaatctaatcagcaacagaatcaggcacaggcagaacaacaatgatcaaggcgacggacagaaaactggtagtaggactggagattggcaccgcgaaggttgccgctttagtaggggaagttctgcccgacggtatggtcaatatcattggcgtgggcagttgcccatcgcggggtatggataaaggcggggtgaatgaccttgagtcagtggtgaaatgcgttcagcgcgccattgaccaggcggaattgatggccgattgccagatctcctcggtatatctggcgctttccggcaaacatattagctgtcagaatgaaattggtatggtgcccatttccgaagaggaagtgacgcaagaagatgtggaaaacgtcgtgcatactgcgaagtcagtgcgcgtgcgcgatgaacatcgcgtgctgcatgtgattcctcaggagtacgccattgactaccaggaaggcattaaaaatccggtcggtctttccggcgtgcgtatgcaggcgaaagtacatttgattacctgccacaacgatatggcaaaaaacattgtcaaagctgttgaacgttgtggtctgaaagttgaccaactgatatttgccggactggcggccagttattccgtgttaacggaagatgaacgtgaactgggcgtctgtgtcgtggatatcggcggtggtacaatggatatcgccgtttatactggcggcgcgctgcgtcataccaaagtgatcccttacgcggggaacgtggtgaccagcgatatcgcttatgcctttggtacgccgccgagcgatgctgaagccattaaagttcgccacggttgcgcgctgggttccattgtcggtaaagacgagagcgttgaagtaccgagcgtaggcgggcgtccgccgcgcagcctgcaacgccagacgctggcggaagtgattgagccgcgttacaccgagctgctcaatctggtcaacgaagagatattgcaattacaggaacagcttcgccaacaaggggtaaaacatcacctggcggcggggattgtgttaaccggcggcgcggcgcaaatcgaagggcttgctgcttgcgctcagcgcgtgtttcatacgcaggtgcgtatcggcgcgccgctgaatatcaccggtctgacggattatgcccaggagccgtattactcaacggcggtgggattgcttcactacgggaaagagtcccacttaaacggtgaagcagaagtggaaaaacgtgttacggcatcagttggctcgtggatcaagcgacttaatagctggctgcgaaaagagttttaatttttatgaggccgccagatattacggcctcaggcgacaggcacatgacggagagagattatgtttgaacctatggaactaaccaacgacgcggtgattaaagtcatcggcgtcggtggtggcggcggtaacgctgttgaacacatggtgcgcgagcgcatcgaaggtgttgaattcttcgcggtgaataccgacgctcaggcgttgcgtaaaacggcggttggccagaccattcaaattggtagcggcattaccaaaggtctgggcgctggcgctaacccggaagtcggtcgtaacgcggcggacgaagaccgtgaagcgctgcgtgcggcgcttgaaggcgcagacatggtatttatcgcggcaggcatgggcggcggtaccggaaccggcgcggcgccagtggttgctgaagtggcaaaagatttaggtattctgaccgttgccgtggtgactaagcctttcaattttgaaggcaaaaagcgcatggcatttgcggagcagggtatcaccgagctgtccaagcatgtggactcgttgatcaccatcccgaacgacaagctgctgaaagtgctgggccgtggtatctccctgctcgacgcgttcggcgcggctaacgacgtgctgaaaggcgcggttcagggcatcgcagagctgatcacccgcccgggtctgatgaacgtcgactttgctgacgtgcgtaccgtgatgtctgaaatgggctacgcaatgatgggctccggcgtggcgagcggtgaagaccgtgcggaagaagcggctgaaatggctatttcttctccgctgctggaagatatcgacctgtccggcgcgcgcggcgtgttggtcaacattactgcgggcttcgacctgcgtctggatgagttcgaaaccgtcggtaacaccatccgtgcctttgcatcggataacgccaccgtggttatcggtacttctctggacccggatatgaacgacgaactgcgcgtgaccgttgttgccactggaattggtatggacaagcgtcctgaaatcactctggtcaccaataaacaggtgcagcagccggtgttggatcgttatcagcagcacggtatggcgccgctgacgcaggagcaaaaaacggtcgcgaaagtggttaacgacaatacaccacaggcggcgaaagagccggattatctggatatccccgcattcctgcgtaagcaagctgattaagaattagctggaatttgggattctgggctctttgtgctaaactggcccgccgaatgtatagtacacttcggttggataggtaatttggcgagattatacgatgatcaaacaaaggacacttaaacgtatcgttcaggcgactggcgtcggtttacacaccggcaaaaaagtcaccctgacattacgccctgcgccggccaataccggggtcatctatcgtcgcaccgacttgaatccaccggtagatttcccggccgatgccaaatctgtgcgtgataccatgctctgtacgtgtctggtgaatgagcatgatgtacggatttcaaccgttgagcacctgaatgctgctctggcgggcttaggtatcgataacatcgttattgaggttaatgccccggaaatcccgatcatggatggcagtgccgctccgtttgtctacctgctgcttgatgccggtattgatgaactgaactgcgccaaaaaattcgtacgcatcaaagagactgttcgggttgaagatggcgataaatgggctgaattcagaccgtacaatggttttacgttggatttcaccatcgactttaaccatccggcgatcgattccagcagccagcgctacgcgatgaacttctctgcggatgcgttcatgcgccagatcagccgtgcgcgtaccttcggttttatgcgtgatatcgaatatctgcagtcccgcggcctgtgcctgggcggcagcttcgattgtgccatcgttgttgacgattatcgcgtattgaacgaagacggcctgcgttttgaagatgaattcgttcgtcacaaaatgcttgacgcgatcggtgacttgttcatgtgtggtcacaatattattggtgcgtttaccgcgtataaatccggtcacgcattgaataataaattgttacaggcagtcctggcaaaacaggaagcctgggaatttgtgaccttccaggacgacgcagaactgccgttggctttcaaagcgccttcgacggtactggcataacgacatacgctgtcgtataaaattcgactggttaacctggcactctctccggccaggcgagccagtcgtttttttactatcctttatctgcgctttccttaatacagccattttgacagggttaaatggaaacacggcgcgttcgctgttttcttagccgattttcaccttagcttctcgtcattactgctgtagcgcgtacgctttaatgataagatttgtgcgcaaattgttttgattccgtaagcccatgaggggcatatcaggtggcaatgacgtgagtggaatactgacgcgctggcgacagttaggcagacgatacttctggccgcatctcttattagggatggtcgcggcgagttttggtttgcccgcgctcagtaacgccgctgaaaccaatacgcctgcaaggacgaccgccagcaccgcgtctaaagttaactttagccattttgcgctgttagaagcctctaaccgtcgtcccaatttcaccgtagattactggcatcagcacgctattcgcacggtgattcgccacctttcttttgcaatggcgccgcaaacgctgcccgttgccgacgcgccgtcgccattacaggcgcatcatatcgccttactgaatacgctcagcgcgatgctcacgcaggagggcacgccgccggcgattgttcgtcgcctctccctggcgtattttgcgccacaaaccgcatttagcatcccggcctggataagtcaggcgcagggtatccgcgccggtccgcaacgtctcagctaacgaaaaaagacccttttactttatttgtagctccgcggcgcggggcatttgagactttattatgctaatcaaattattaaccaaagtattcggtagccgtaacgatcgtacgctgcgtcgtatgcgtaaggccgtcagccttattaatgcgatggaaccggagatggaaaaactctccgatgacgaactgaaagcgaaaaccaacgaatttcgcgcccgtattgaaaaaggcgaaagcgtagagagcctgattccggaagcgttcgcggtggtgcgtgaagccagtaaacgcgtctttgggatgcgtcacttcgacgttcagctattgggtggtatggtgctcaacgatcgttgtatcgccgaaatgcgtactggtgaaggtaagacgctgaccgcaacgctgccagcctacctgaacgcgctgtccggcaaaggcgttcatgtggtaaccgtgaacgactatttggcgcagcgtgacgccgaaaacaaccgtccgctattcgaattcctcggtatgtccgttggtatcaacctgccaggtatgcctgcgccagccaaacgtgaagcttacgctgccgacatcacttacggcactaacaacgaatacggttttgactacctgcgcgacaacatggcgttcagcccggaagagcgcgtgcagcgtaaactgcattatgcgctggtggatgaggtcgactccatcctgatcgatgaagcgcgtacgccgctgatcatttccggcccggcggaagatagctcggaaatgtacaaaaaagtgaacaaaatcattccgcacctgattcgtcaggagaaagaagattctgacactttccagggcgaaggccacttctccgttgatgagaaagcgcgccaggttaacctgaccgaacgcggtctggtgctgattgaagagctactggtgcaagaaggcattatggatgagggcgagtcgctctactcgcctggcaatattatgctgatgcatcacgtcaccgccgcgctgcgcgcgcacgcgctgtttacccgtgacgtggattacattgtgaaagacggcgaagtcatcattgttgatgaacataccggtcgtaccatgcaggggcgtcgctggtctgacggtctgcaccaggcggtagaagcgaaagaaggcgttgaaattcagaatgaaaaccagacgctggcgtctatcaccttccagaactacttccgtctgtatgaaaagctggccggtatgaccggtacggcggatactgaagccttcgaatttagctctatctataagctggacaccgtcgttgttccgaccaaccgtccgatgatccgtaaagatttgccggatctggtctacatgaccgaagcggaaaaaatccaggccattatcgaagatattaaagaacgtaccgcgaacggtcagccagtgctggtcgggacgatttctatcgagaaatctgaagtggtctccagagagctgaccaaagcgggcatcaaacataacgtactgaacgcaaaattccacgccaacgaagcaggcatcgttgcgcaggctggttatccagcggcggtcactatcgctaccaacatggcgggtcgtggtactgatattatgctgggcggtagctggcaggcggaagtcgccgcgctggaagcgccgacggaagaacagattgcgcagattaaagcggactggcaggtacgccatgacgcggttctggctgccggcggtctgcatatcattggcaccgagcgccatgaatcccgccgtatcgacaaccagctgcgtggccgttccggtcgccagggcgatccgggttcttcccgtttctacctgtcgatggaagatgcgctgatgcgtattttcgcctccgatcgtgtctccggtatgatgcgtaaactgggaatgaagccgggcgaagcgattgagcacccgtgggtgacgaaagctatcgctaacgcgcagcgtaaagtagaaagccgtaacttcgatattcgtaagcaactgctggaatatgatgatgtggcgaacgatcagcgccgtgcaatttatacccagcgtaacgaactgctggatgtgtctgacgtgagcgacaccattaacagcattcgcgaagatgtctttaaggcgactatcgacgcctacattccgccgcagtcgctggaagagatgtgggacatcccgggtttgcaggaacgcctgaaaaacgacttcgacctggagatgccgattgccgaatggctggataaagagccggagctgcatgaggagacgctgcgtgagcgcatcctggcgcagtccatcgaggtgtatcagcgtaaagaagaggtggttggcgctgaaatgatgcgtcatttcgaaaaaggcgtgatgctgcaaacgctcgattccctgtggaaagagcatctggcggcgatggattacctgcgtcagggtattcatctgcgtggctatgcgcaaaaagatccgaagcaggaatacaagcgcgaatccttcgctatgttcgccgcgatgctggaatcgctgaaatatgaagtaatcagtaccctgagcaaagtccaggtacgtatgccggaagaggtcgaagcgatggaaatgcagcgtcgcgaagaggcggagcgcctggcgcagatgcagcagctaagccatcaggatgacgatgccgccgtggctgccgatctggccgcccaaaccggcgaacgtaagattggacgtaacgatccttgcccttgcggttctggtaagaaatacaaacagtgtcacggtcgcctgagctaatgcgataaacttaccggcctgataagacataatgtgttgccatcaggtcagtactggcattattgccgaagggcgctacgcttattcggcctggcattgaacacagataaaaaggcgcaggcgactgcgccttttttatggatgcaacaagatgaaaaaactgcaaatcgcggttgggattatccgcaacccgaacgacgaaatttttattacccaacgcgccgctgatgcgcatatggcgaacaagctggaatttcccggcggaaaaattgaagccggcgaaacaccagagcaggcgttgatccgggagctacaggaagaggtggggattacgccaacacaggtgacactattcgacactctggaatatcaattcccggatagacacattacgctgtggttttggctggttgaacgctgggagggcgaaccgtgggggaaagaaggacagccgggacggtggatcgcgcagaacgcgttgagtacggacgattttccgccggccaatgaaccgattattcgtaaattacgccaatttgcgctttagtgggggatcgcaacacgatccccatcgatcttattagcgatttaatgtcgacataatttccggccagtagcgggggccggccgcggcgtcgtgaggaaaaaccgcctcaattgccgtcagctcctgcgggcttagggtcagtgataacgcgccgaggttttcatccaccctggcgcagtggcggctacgtttctgttatagcctaatctcgccggtttatttgtattatcccggccgcgcgcatatggcaccaaaactacgcgtatttattgattatttttgtcataaggcgatattgccgtctcaacagagccatcaccgttagcgctcttcgctccagtcgtcgctatcagactgatcgccgctgctggcgattcgtttctcttcggcggcccattcgcccaaatcaattaactgacagcgtttagaacaaaatgggcggaaggggctaatttccccccagacgaccggtttaccgcaggtcggacagtttacgacggtcacgtcagacatttttactccttagcaacaggccagttcaaaatcaagacgctccggcaccagaccattttcactatccagcggcataaagcgaatggcaaaacggctcttatggccggaaatttgcggataaagttgtgaatcgagcgtcagcataagacgcagcaaatcggcgtcgtccccgttatcctgataaaaaccgttcaggctggtttgcttacggaaaggcgctgaattacggatcagatcaagcaccagcgtcagcgcctgggtgaggggattcaggctggcaagccagctttcaatctgggcatcgcgctgcgcctgttgtaggtgcaaccagatatgcagagtgggtaaatcgaaactgcaacagccgccaggaatacttaagcgttgacgcacaagagcaatcaagcgatcttcgcgtagctgctggccaatcctcggggcggagatcagcacgctgcccgccgattttaactgctggcgcagggcttcaatacggtcttgatcgacgccgggaacctcaacccaggcctgtaatttacgctgctggcgctccagttctttcagcagttcggtacggacttcgccccgttcgaacacatccagtagatcgctgatattacggaaaaaatgcagtgcgccagcatggtctgcaattggcaggttgatggagagctgttggatcaaaaactctatgcgcagccacgtacgcatcttctcattgagagggtgttcaaataggacctgggtgtgcattacggtttttcctgtgagacaaactgcgacgcgagcttaagataactggcgtgcaggcgggccacatctgatgcgatagcatccggtgcgccgttattatcaataacatcgtccgccacggcaaggcgcgcttcacgcgtcgcctgcgcagcgagaatgtgttcaacatgctcgcgcgtaacatcatcacgctgcattgtgcgtatgagctgcgtttcgggcgtcacgtcaaccaccagtacgcggttggctttttgatacagcctgttttcaaccagcagaggcacaacccataacacatagggcgacgtagcctgctgaaactgtcgttgggtttcctgctgaattaagggatgaagcagagcgttaagccaggctttttcttccggatgcgaaaaaatacgctcacgcagcgcccggcgacgtaacgtgccgtcggcggcgataagttcagaaccaaaatgttccgctattgcgttcagggcgggctgccctggctcaaccatctggcgcgcgataatatccgcgtcgatgacggttattccgaggtcagcgaaggcatcagcgacggtacttttaccgctgccaataccgccggttaaggctacggtatacctcatatctccagcttccggaattttagtttgataatcaaaaggttaaattttaaacatacaaagacgatacgctctgagcattaacctactattcgccaggtaaatttatgggattgtaacgtaaaaaaagagaatttcgcagtcttgtacggccatgattagtgcgtatgatagcgtcactggagttgtgagtttcgatttttcgccattaaccccaggaatccgtacatgcgtattgaagaagatctgaagttaggtttcaaagacgttcttatccgtcctaagcgttctaccctcaaaagccgttccgatgtcgaactggaacgtcaattcacctttaaacactcaggtcagacctggtctggcgtaccgattatcgcggccaatatggataccgtcgggacgtttgaaatggcgcaagcattggccgggtttgatattctgactgctgtacataaacattataccgttgaagaatgggcagcttttatcaacacggcctcggctgatgttctgaagcatgtgatggtttccaccgggacctctgatgctgatttcgaaaaaaccgtgcagattctggcgctgaatcctgcgctgaactttgtctgtattgatgtggccaatggctattcagaacattttgtgcagttcgtcgcaaaagcgcgtgaagcatggccgacaaaaacaatctgcgcaggcaatgtggtaacgggcgagatgtgcgaagagcttatcctctccggcgccgatatcgtgaaagtgggaattggtcccggctccgtatgcacgacgcgtgtaaaaaccggcgttggttatccgcaactgtcggcggttatcgaatgtgctgacgcggcgcatggcctgggcggtatgatcgtcagcgatggcggctgcaccatgccaggcgacgtagcaaaagcctttggcggcggcgcggatttcgttatgttgggcggcatgctggcggggcacgaagagagcggcggcagcgtggtagaagagaacggcgagaaatttatgctgttctacggcatgagttcggaatctgcgatgaaccgtcatgtcggcggcgttgcgaaataccgcgcggcagaaggtaaaacggttaaattgccgctgcgtgggccggtgggcaatactgcccgcgatatcctgggcggtctacgctcagcctgcacttatgtcggcgcgtctcgcctgaaagagttgaccaaacgcaccacctttattcgggtgcaggaacaagaaaaccgcattttcaatagcctctaatattctggctggcgtaaatgtgcgccagccttatcccatcccgctcatcgcgtctcccagatgaaaaatcggcaaatacatcgccactaccagcgtaccgataattaagccggtgatgatcaataacgccggttccaacagcgacgccagattatcggccagcgccagcgtagtttcactgtggtgacgggcaaggttatgcagcatgatatcgagtgaaccggacgcttcgcccgttctgaccagttgcaggcatagcggactaaattcctgggtattttttagcgccaaccagaccggattgcccgcggcgatctcctgatgtacctgcgttaaacgctgtgaccagtaagggcagccgagactatcgatagcgctttccagtccctgaagaaaaggaatacctgcgctttgggttaatgccagtacggtgaatatttgcgctagtttctggcctcttatcaggcgacccataacgggaagccgtagcagaagacgctgccgctgcgcttgccaggacggcttttgttttaccctgcggtgagcgatagcaacgagcatcgtcaggaacaagatgagccaaccccatgccgacccccattgcgctatcgcaataataccgcgtgtcagaagaggaagcggggtattgaagctacggtaaatggcggcaaattccggcaggacaaagtgcagcatggcgaaaacgaccagggcggccattgttagaataatggcgggatagcgcagcgcctttttcacgctaaccgtaatctgccgttgcgctttttgctgacgggccagttcaaagcagcattcggccagtttgccggtcagttctccggtgcggatcatcgtctggtagagcggcggaaatacctgcggccaggagactaatgcgctggaaaaagggacgccctgttcaagctcgtgagccagcgtgcgcaacagcgcttgccattgtcggtggggatgctgtttcgcaaggagttccagcccttctgaaagcgtcagcccggcatgaatgagcgtggccaactgatgaataatttcagcgctttgctcttctttccacagtgcggcgttaacgcccatgcgcttgatgcgaagcggcataatgcgctgatgttgcagggtgatgatcagcgccagacgattgtccgcccatacaacgtcttgttccagttgacctttatcgttaacgccttgccagcgccagagctgtttaacgctcatggggcattcccagaacgcacagtatctcttcaaaggacgtcatgccttgctcaacggcgcgacagccattttcaaaaagcgtccctgtaccggtctgttggaggtgggcttccagtgcttgcgccgatgcgccgctcgcaattaactgacgtaatgccggggtaacggttaacacttcgaataacgcggttcggccataaaagccgtggtagcaatgctgacagccgcttgcctgccagcgcggtatcgcgctgggccaaagattgggcgatagcaccacgggatcgctcagacgctgtttgcagtgcgggcaaagcttccttaccaggcgttgcgctaccaccagcgtaagcgccgatgagatcatccagcgtgctacgcccatttgctgcaaacgtatcagggtttcgctggtggagttcgtatggagcgttgaaagtaccagatggcccgtttgtgccgccttaatggcgatttctgcggtgtcgccgtcacgaatttcacctaccatgatgatgtcagggtcctggcgtaaaagcgcgcgcagcacattttgaaaggtgagcccggcgcggggatggatctgcgtctggttaatcccatccagtggaatttctatcggatcctcaacgctacagaggttgatacccggcgtattccgggtttgtagcgcgctgtatagcgtgaccgtttttccgctaccggtggggccagtcaccagtaccagcccctgaggttgctgtagggcttgtctaaaagcggtaagttgtgccccgtacatgcccagcgtgtccagatccagcgtttgttcaacctgatgcaacaaccgtaagacgactttttcgccttctttacagggaagcgtggcgatacgaaaagagatgctgtcgcccgccaggtcaacggtaaattgcccgtcctgcggcagtcgatgttcagcgatgtccaaatttcccaggactttcaatctggccgtcagcgcaagccccgtctctttggcgatgtcctgcagaatatgaagaacgccgtcgatgcggagtcttattcggtagcggctggcgccgggttcgagatggatatcagaggcgcgtttcgccatcgccgagcgtaatgtctgattgagaagctgggctgcggtttctccgcctttcgcggcgtttgccgagggtgcctgatccggcttatgccgatgattttccatttgctggcgagtccagcacacaatatcaatctgtttttgcgtggcgaaatgcagagcgtccagtaacgcatgagagggcgcgtcgaccaccgcaacagtgatactgttgctggcgctattgatcagtacagcctgatgacgttgacacaaggtgttgagctgagcgtctttcatcttgtctccttagttggcgtcaaaacggaagacatcttcacaagcctgttgtaacgcgctgtcgctttgaatattgcagttacgcgtccagccagtaatgccgttagcattgtcccaggcgggcgtcatgatgacgctaagcccgctcagactctcctggccggtaagcgtgatgacgcctttttccacgctcatgcccgaaacataacgggtgatgacgggcgaggggataccgttgacgcccgcatcgcatgtgctcgtcccaccatgttccagagcgcagagttcgacggcagtacggtaggggacaaacgtttgcaacatatccgtcagcgccgctttacgcagatagttctggtaagccggaatgccaatggcgcttaaaatggcgatgatgccaataacgaccatcagttcgataagcgtgaaaccgcgttgtttttccattgttcgctccttgagttagctggcgctactgtggcaaacgcgggaagagcgggcgagcggcaaaaggtaaaacgggaaggcggattctgaagattttcgctgcgttacatgacacggcaacgttattgcgaggcgctacgaatattttaccgaataatgacgcggatctacggacaggtgatttatagacccgacggcgcagcgccatcgggtggagaggatcagcaaaaacgcatggagagatcgagcgcgcgcacgtgcttggtcagcgcgccaacggagatgaaatccaccccggtttcagcaaattcgcgtaaggtttccgcggtgacgttgccggatacttccagccgcgcctggccgttgacgcgtttcaccgcctcgcgcatctggtcggtgttgaaattatccagcatgataatatccgcgcctgctttcagcgcatcgtccagttcatccagattttcgacctcgacttctaccggcacgtccggatgtagccagaacgctttttccaccgcctgacgaaccgaaccggaggcgataatatggttttctttaatcaggaacgcgtcagtgaggcccagacgatgattggcgccgccgccgcataaaaccgcatatttgagcgcggtgcgcagacccggcagcgttttacgcgtgtcgagcaactgggtttgggtgccagccaacagtccaacgtagcggcgtacttcactggcgacgccggaaagggtctggacaaagtttagcgccgtgcgctcgccggtcagcaatacgcgagccgggccgttcagttcaaacactgtttggttggcgtgaatggcgtcgccgtcatcgacatgccaggtgaggcgcacatcatcgcccgccagttggatgaagacctcttcaacccagcgcttgccgcagaaaacgccgtcttcacgagtgatcaccgtggcatgggcttgcgtatctgccggcaaaagttgcgcggtgatatcgttgccagcatcgacttctccacctaaatcttcacgcagcgcctgagcaacggcggcagggatatcgagattaatgcgttccagtagcgcgtcacgtcggtcgtctgggttataacggcgaggcggcatgataaaactccaaattgctaacgaatcataaggtagaaacatgctactctgaagcagctataagcaccactcaaaaggagactccgcatgttgccagataagggttggttggtagaggcgcgacgcgtcccttctccgcattatgattgccgtccggatgacgaaaaaccgtccttgctggtggtgcataatattagcctgccccccggcgagtttggcggtccgtggatcgatgcattattcaccggaacgatagatccagacgcccatcctttttttgcagaaatcgctcatcttcgtgtttcggcccattgtctgattcgtcgcgacggtgaaatcgtccagtatgtgccttttgataagcgtgcgtggcatgcgggcgtgtcaaactatcaggggcgggaacgttgtaatgatttctccattggtattgagctggaggggacggatacgctggcttataccgatgcgcagtatcagcagctagccgccgtgacgcgcacgcttatcgctagctatccggcgatcgccgacaatatgaccggacactgcaacattacgcctgaccgcaaaacggaccctggccctgcctttgactggccgcgctttcgcgctttggtagccctctcgtcgcacaaggagatgacatgacgctgtttacgacattactggtgctgattgtcgagcgcctgtttaagctgggcgagcactggcagctcgatcatcggctggaggcgctattccgtcggattacgcatttttcgatgttgcgcacgatgggaatgacggcgatcgcgatggtggtgacttttctactgctccaggcgttaaaagggctgctatttaacgtgccgacgctggtggtgtggattctcctgggcgtgctgtgtatcggcgcgggcaaagtgcgagtacattatcacgcctggctgaaagcggcgtcccgtaacgatccgcatccttgcgaggcgatggccagcgagcttacgctgattcacggcgtgccgccggattgtaatgagcgtgaatttttgcgtgagctgcaaaatgcgttgttatggataaatttccgtttttacctcgcaccgctattttggtttatcgttggcggtccgtgggggccggtaacgctggtgggctatgcgtttttacgggcctggcagacctggctggcgcgctatcagacgccgcaccaacgtttgcaatccggcattgacgctattcttcatgtgctggactggattccggtacgtctggcgggcgtagtgtatgcattactggggcatggcgagaaagcgttgccggcctggtttgcctcgctggcggatctgcatacttcgcaatatcaggtgctcacacgtctggcgcagttctcactggcgcgcgaaccgcatactgacaaagtagaaacccccaaagcggcggtgtcgatggcgaagaaggcctcgtttgtggtggtggtgattattgcgttgctcaccatttatggggcattagtgtagcgttgtgccgatggcgctaacgcttatgctgcctacaatggaaaaatctgtaggcccggtaagcgttagcgccaccgggcagtgcaacggcttagatcgtatcggctggcggcacgccaaaatcaggcatcccgttttcgtcccagcgcacccgtttcagacgcgtatggcggttgggatcgtacaacggatcgccttcaatttcggtgtaatttctcgcgtggtacaccagtacattttcaccttccggcgtttgcgtaaagctgttgtgtcccggtccatactggcgattctcatagctggtggtaaagaccgggcgcggtgatttatgccagttggccggatcgcgcggatcgtcgtttacgttaatccacagtaatcccatacagtagttttcatcggtggcgctggccgaatagctgataaacagcttgtcgccatgcaccacgacggccggaccttcgttaacccaaaaaccccgacactcccagtcgtactctggcttactgagtcttaccggctcgcctttaatcgtccacggattttccagttcagccagataaatatttgagttaccggcaatatccggcgctttttgcgcccacagataccactgctttccctgatgataaaaagtggtggcatcgagggcgaaggtatcaaacggtgttttaatttgacctttctccgtccacttgccggtgagtgggtcggcatcggcgcactccagggcaaacatgcgatgctggaacattcccagcttatcaagcgcttgagtatgggtagcggcaaaatagatgtaccacttgccgttgatgcggtgcatttccggtgcccagatgagctggctcatcgggccgctttccggtttacgccagacgacaacggggtcggcggcgcgcaacccttccagcgaattagcccggcggatttccagcctgtcatattccggtacggaggcaataaagtagtaatcgctgccgtcgcgtaaaataaacggatcggcacgttgttcaataaacgggtttggccagtttgccatcaggctttccttacgctttcagcggcgttgagctcctgcaactcactcaattcgcggtaattagtgcgacgtttttccaaatcgtcctggatttttttcatcagttcacggtcaactttcagcagacgtaccacgcctgcggtaatcagatagccaacgccggggataacggtaaacaacagcataataccgttcatcgccgaggcgctttgcgctttggcgctggcgtcataaccgtaccaggagagcaaaaagccgaccatcgccccggcaatcgccaggcccagtttcaggaagaacaggttaccggagaagctgataccggtaatgcgtttgccggttttccattcgccgtaatcatcgacgtccgccatcagcgaccagtgcagcggggaagggatctgatgcagaatattgagcaggaagtagagcgccactatcatcacggtggctttcggatcaaagaaatagaacgcgcaggagaaaatcgccagcgcaatattggtccagaaaaataccttcaatttacaccagcgatcggttaagacttttgccagcatactgccgatcatcataccgaccacgccaagactaataaaaagcgtagcgaaatgggtgctttgtcccatcacccaggtgacgtaatacatggtcgccgccatacggataaaccccgggcagacgttacataaggtcaatagcagaatgcgtacccattgatcgtttttccacacatctttgaaatcattcttcatatcatcgtgcgtcggaacggcagggcggacgcgttcgcggacgctggcaaagcagaacagaaacatacccatgccgataatcgccagcacggtcatcgccaactgatagcctttggctttgtcgccgccgccaaaccagtccaccatcggcaatagcgttaacgatagcaacagcgtcgcgatgccgactaatacgaagcgataagcctgacaggccacgcgctcttttggatcgttagtgatcacgccgcccagtgagcaatagggaatattgatggcggtgtaggtcacggaaagcagaaaataggtgacgaaagcatagacaactttgctgttatagccccagtccggcgtcgtgaacatcagaacgctgaacagcgcgtagggaaatgcaatccacagtagccaggggcggaaacgaccatatttactttgggtacgatcggcaagcgcgcccatcaccggatcggtaacggcatcgataacgcgtactgaaaggagtaaaacaccgactaacgccggggcaagaccaaaaatatccgtataaaagtaattaacaaacagcatgatagcgccaaaaataatgttacatccggcgtcacccatgccatacccgattttctctcttaccgaaagtctgcccttatccattgagacttctccccatcagatgatggcggtaattattcgcctgcgagcttttttttgcgtagcaggatcacgccgctgatatggataaaatggttatacgtgggaaactgtgaggcagataacaccctccccggacggggagggcggaaaagtaacgccacgatcagtgggctttcaccgtttttgccgttttttctttacacaggtagccgacgcccaggatgagcagccataccggaatcagccacacggagatcgccatacctggcgtcatcagcataatgatcaataccgccgccataaacagcaggcagagaacattgccgaacggataaaacagggccgggaagcgggttttcacgccctgctgctgtttcgcgcgacggaacatcatatgggcaaggctaatcatcgcccagttaatgaccagcgcggagaccaccagcgccatcagcagtccgaatgcggactctggggccaggtagttgagcagcacgcacaacgcagtcacgacggcggaaaccaaaatggagctcaccggcacgccgcgtttgtcgacgttcagcagcgctttcggcgcatttccctgctgggccagaccgaacagcatacggctgttgcagtaaacgcagctgttataaaccgatagcgcggcggtgagaaccacgatattcagcgcattggcgacaaacgtatcgcccagctcatggaagataaggacaaatgggctggtatcggcggtgacgcgagtccatggcagcagcgaaagcagaaccgccagcgagccgatataaaaaatcaggatgcgatagataacctgattagtggctttggggatgctctgttccgggttatcggcttcagcggcggtgatccctaccagctccagtccgccgaacgaaaacataataatggccatcatcatcaccagcccggtccagccatgcggcagaaagccgccctgttcccacaggttgcgcacggtggcctgcggaccagcggtatcgctgaagagtaaccacgcgccgaacagaatcatagcgatgacggcgatcactttaataatggcgaaccaaaactccatctcaccgaacactttaacgttggtcaggttgatggcgttgataatcacaaagaaggctgccgcagaagcccaggtggggatctccggataccagaactggatatatttacccactgcggtcagttccgccatggcaactaatacgtacagcacccagtagttccagccggaagcgaatccggcaaagccgccccagtatttataggcgaagtggctaaaagagccggcgaccggttcttcaaccaccatctcccccagctggcgcataatcagaaaggcaataaagcctgcaatcgcatagcccaggataattcctggccccgccgactgaataacggaggcgcttcccaggaacaagcctgtccctatcgcgccgcccaatgcgataagctgaatatggcggtttttcaggccgcgcttgagctgctcgccgtgctgctgactgtccatcataaaacctcgtgtatcgggcgcggtttattcataacgcgcttattttgaacgatgcagtagtgcgtgtgtaagtttgcaattccgctttttgtattgatttatttacaagctcgttttttaaaatgtcacttcaactctttcgtcttgatcagaataatggtatgtggccgcgaatgcacctgctttgtgcaggggtgatgacgagttgcgtaaaaagaaagcacttgtaaatacctccttttattttcccttacagatgttaatttgtttttattcattatttatgcataaaaatgcatttaatctactgttgaatcggttcagatgagattttttatcgtttcaaatacgttaaatctacctcctggtgggtaaatttaacatttgtgcacagttacagttttgaaacatgatttctgtaaaattgttaaaatgtgcctcctttactgatttcaatcaaaacctgtatggacagaaggtgaatactttgttactttagcgtcacagacatgaaattggtaagaccaattgactccgggcaaatggcttaagacaggaaatcatggcctacagcaaaatccgccaaccaaaactctccgatgtgatcgagcagcagctggagtttttaatccttgagggaacattgcgtcccggagaaaaactcccaccggaacgtgaactggcaaaacagttcgacgtctcccgtccctccttgcgcgaggcgattcaacgtctcgaagcgaagggattgttgcttcgtcgtcagggcggcggaaccttcgtgcagagcagcctgtggcagagctttagcgacccgctggtggaactgctctccgatcaccctgaatcccagtttgacctgctcgaaacgcgccatgcgctggaaggcattgcggcttattacgcggcgctgcgcagcaccgacgaagataaagaccgtattcgcgagctgcaccatgctattgagctggcgcaagagtccggcgatctggatgccgagtccgaagccgtgctccagtatcaaatcgccgtcaccgaagcggcgcacaacgtggtattgcttcatctgctaaggtgtatggagccgatgctggcgcaaaacgtgcggcagaacttcgaattgctgtatgcgcgtcgggagatgctgccgctggtgagtacgcatcgcacccgtatatttgaagccattatggccggaaaaccagaagaagcgcgtgaagcgtcacaccgacatctggcgtttatcgaagagattatgctggacagaagccgtgaggagagccgtcgtgaacgcgctttacgccgcctggaacagcgcaagaattagttttttctggcagaacgttaaccagaagatgttgtgaataacgcgcaaaaatgtgcgcggcaactaaacgcagaacctgtcttattaagctttctcacgaaagtttaatgggacaggttccagataactcaacgtattagatagataaggaatacccccatgtcagaacgtttccaaaatgacgtggatccgatcgaaactcgcgactggctacaggcgatcgaatcggtcatccgtgaagaaggtgttgagcgcgctcagtatctgattgaccaactgctttctgaagctcgtaaaggcggcgtgaaagtcgcggcaggcgcaggggccagtaattacatcaacactattgccgttgaagacgaaccggaatacccgggtaatctggagctggaacgtcgcattcgttctgcgatccgctggaacgccatcatgaccgtgctgcgcgcgtctaaaaaagaccttgagttgggcggccacatggcgtccttccagtcttccgccacgatctatgatgtctgttttaaccatttcttccgtgcgcgcaacgaacaggatggcggcgacctggtgtacttccagggccacatctctccgggcatctacgctcgcgcgttcctggaaggtcgtctgacccaggaacagatggataacttccgtcaggaagttcacggcaatggcctctcttcctatccgcacccgaaactgatgccggaattctggcagttcccgaccgtctctatgggtctgggcccaatcggtgctatctaccaggcgaaattcctgaaatatctggaacaccgcggcctgaaagatacctctaaacaaaccgtttacgccttcctcggcgacggcgagatggatgagccggaatccaaaggcgcgatcaccatcgccacccgtgaaaaactggacaacctggtctttgttatcaactgtaacctgcagcgtcttgacggcccggtcaccggtaacggcaagattgttaacgaactggaaggcatctttgcaggtgctggctggaacgttatcaaagtcatgtggggcggtcgttgggatgaactgctgcgtaaagacaccagcggtaagcttatccagctgatgaacgaaaccgttgacggcgactaccagaccttcaaatccaaagacggcgcttacgtgcgtgagcacttcttcggtaaatacccggaaaccgcagccctggtggccgactggaccgatgagcagatttgggcgctgaaccgcggtggtcacgatccgaagaaagtctatgctgcactgaaaaaagcgcaggaaaccaaaggcaaagcgaccgtaatcctggcccataccattaaaggttacggcatgggcgacaccgcggaaggcaaaaacatcgctcaccaggtgaagaaaatgaacatggacggcgtgcgttacgtccgcgatcgtttcaacgtgccggttgccgatgctgatctcgaaaaactgccatacattaccttcccggaaggttctgaagaacacaaatacctgcatgaacgccgtcaggcgctgcatggctacctgccaagccgtcagccgaacttcaccgagaagttagagctgcctcaactttcagatttcggcgcgctgctggaagagcaaagtaaagagatttccactacgatcgctttcgtgcgtgccctgaacgtgatgctgaagaacaagtcgatcaaagatcgtctggttccgatcatcgccgacgaagcgcgtactttcggtatggaaggtctgttccgtcagattggtatctacagcccgaacggccagcagtacaccccgcaggaccgtgagcaggttgcttactacaaagaagacgagaaaggccagattctgcaggaaggtatcaacgagctgggcgcaggcgcatcctggctggctgcggcgacctcttacagcaccaacgatctgccgatgatcccgttctacatctactactctatgttcgggttccagcgtatcggcgacctgtgctggcaggctggcgaccagcaggctcgcggcttcctgatcggcgggacttccggtcgtactacgctgaacggcgaaggtctgcagcacgaagatggtcacagccacattcagtcgctgactatcccgaactgtatctcttacgacccggcttacgcttacgaagtggctgtcatcatgcatgatggtctggagcgtatgtacggtgagaaacaagagaacgtttactactacatcaccacgctgaacgaaaactaccacatgccggccatgccagcaggtgccgaggaaggtatccgtaaaggtatctacaaactcgaaaccctcgaaggtagcaaaggtaaagttcagctgctgggctccggttctatcctgcgtcacgtgcgtgaagcagcacagatcctggcgaaagattacggcgtaggttctgacgtatatagcgtgacctccttcaccgaactggcgcgtgatggtcaggattgtgaacgctggaacatgctgcacccgctggaaaccccgcgcgttccgtacatcgctcaggtgatgaacgacgctccggctgtagcatctactgactatatgaaactgttcgccgagcaggttcgtacttacgtaccggctgacgactatcgcgtactgggtacggatggcttcggccgttccgacagccgtgagaacctgcgtcaccacttcgaagttgatgcttcttatgtggttgttgcagcgctgggcgaactggctaaacgtggcgaaatcgacaagaaagtggtagcggatgcgattaccaaattcaacatcgatgcagataaagttaacccgcgtctggcgtaagaggtaaaagaataatggctatcgaaatcaaagtaccggacatcgggacagatgaagttgaaatcaccgagattctggtcaaagtgggcgacaaagtggaagctgaacagtcgctgatcaccgtagaaggcgacaaagcctctatggaagtcccgtctccgcaggctggcgtcgtgaaagagatcaaagtctctgtcggcgacaaaaccgagaccggtgcacttatcatgattttcgattccgccgaaggtgcagccgacgctgcacctgctaaggcagaagagaagaaagaagcggcgccggcagcagcacctgctgcggcagcggcgaaagacgttcacgttccggatatcggcagtgacgaagttgaagtgactgaagtgatggtgaaagtgggcgacaccgtagaagctgaacagtcgctgatcaccgtcgaaggcgacaaggcctctatggaagttcctgctccgtttgcaggcaccgtgaaagagatcaaagtgaacaccggtgataaagtctctaccggctctctgattatggtcttcgaagtggcgggtgaagcaggcgcagcagcaccagcgaaagcggaagccgctccggctgcggctgctccagcagcagcgacgggcgtgaaagacgttaacgtaccggacatcggcggcgacgaagttgaagtcaccgaagtgatggtcaaagtcggcgataaagttaccgctgaacagtcgctgatcaccgtagaaggcgacaaagcctctatggaagttccggctccgttcgcgggtaccgtgaaagaaatcaagatcagcaccggcgataaagtgaaaaccggttctctgattatggtcttcgaagtagaaggcgcagcgcctgcggccgctccggctaaacaggaagcggcggcgccggctccggcggcgaaagctgagaagcctgctgccccggctgcaaaagcggaaggcaaatctgagttcgctgaaaacgacgcgtacgttcacgctactccgctgattcgccgtctggcgcgcgagtttggcgtcaacctggcgaaagtgaaaggcaccggtcgtaaaggccgtattctgcgcgaagacgttcaggcttacgtgaaagacgctatcaaacgcgcggaagctgcgccggctgctgcgggcggcggtatcccgggtatgctgccgtggccgaaagtggacttcagcaagtttggtgaagttgaagaagtggaactgggccgtatccagaaaatctctggcgcgaacctgagccgtaactgggtgatgatcccgcacgttacgcacttcgacaaaaccgatatcaccgatctggaagcgttccgtaaacagcagaacgccgaagctgagaagcgcaaactggatgtgaaatacacgccagtggtcttcatcatgaaagcggttgccgctgctctggaacagatgccgcgcttcaacagctctctgtccgaagacggtcagcgtctgaccctgaagaaatacatcaacatcggcgtggcggttgataccccgaatggcctggtggttccggtctttaaagacgtgaataagaagagcgtgaccgagctgtctcgtgaactgaccaccatctccaaaaaagcgcgtgatggtaagctgaccgctggcgaaatgcagggtggttgcttcactatctccagcatcggcggcctgggaactacccacttcgcgccgattgttaacgcgccggaagtggctatcctcggcgtttctaagtcggcgatggaaccggtgtggaatgggaaagagtttgtgccgcgtctgatgatgcctatctctctttccttcgaccaccgtgtgatcgatggtgctgatggtgcgcgtttcattaccattatcaacaatatgttgtctgacattcgccgtctggtgatgtaagcgaaaagccggcccgacggccggctttttttgataatctcatggagtttgtgaggttattagcgaaagcgataattcgtgatccgtttgttgtttcaaaattgttaacaattttgtaagatacgggcggatagaacgacccggtggatgatgggcgatcaagtaccccggaccgccggatacaaataaagaggtcatgatgagtactgaaatcaaaactcaggtcgtggtacttggggcgggcccggcaggctattctgccgctttccgttgcgctgatttaggtctggaaaccgtaattgtagaacgctacaacacccttggcggtgtttgtctgaacgtcggctgtatcccttctaaagcgctgctgcacgtagcaaaagttatcgaagaagccaaagcgctggctgaacacggtatcgtcttcggtgagccgaaaaccgatatcgacaagattcgtacctggaaagagaaagtgatcacgcagctgaccggcggtctggcgggtatggccaaaggccgtaaagtgaaagtggtcaacggtctgggtaaattcaccggggcgaacaccctggaagtggaaggcgaaaacggcaaaaccgtgatcaacttcgacaacgcgatcatcgcggcaggttctcgtccgatccaattaccgtttattccgcatgaagacccgcgcgtatgggattctaccgacgctctggaactgaaagaagtgccgaagcgtatgctggtcatgggcggcggtatcatcggtctggaaatgggtaccgtataccacgcgctgggttcagagattgacgtggttgaaatgttcgaccaggttatcccggcggctgataaagacatcgttaaagtcttcaccaagcgcatcagcaagaaattcaacctgatgctggaaaccaaagtgactgccgttgaagcgaaagaagacggtatctacgtttcgatggaaggcaaaaaagccccggctgaagcgcagcgttatgatgcggttctggtggcgattggtcgtgtgccgaacggtaaaaacctcgacgcgggcaaagctggcgtggaagttgacgaccgtggctttatccgcgtggacaaacagctgcgcaccaacgtgccgcacatcttcgctatcggcgatatcgtcggtcagccgatgctggcgcataaaggcgttcacgaaggccacgttgccgctgaagttatcgccgggaagaaacactacttcgatccgaaagttatcccgtctatcgcgtacaccgagccagaagtggcatgggttggcctgaccgagaaagaagcgaaagaaaaaggcatcagctatgaaaccgccaccttcccgtgggcagcttctggccgtgctatcgcttctgactgtgcagacggtatgaccaaactgattttcgacaaagaatctcaccgcgtgatcggcggggcgattgtcggtaccaacggcggcgagctgctgggtgaaatcggtctggcgatcgaaatgggctgtgacgcggaagacatcgcgctgaccattcatgcgcacccgactctgcacgagtccgtcggtctggctgctgaagtgttcgaaggtagtattaccgacctgccgaacccgaaagcgaagaagaaataatcttctgtaggtggcaatgcgccacccgatacaaaaaagcggctttacagccgctttttttatgcatggcaaatcagatgtgtcaaatgatggcgaaggataacgaaaccgcaaaatttatcgtttccgcagcagtacgtttttcaaagcttatgccgtcggtagtgcctttgtctgtcattttcgaccaactaattgtttcataagaaatacctctccttactttgtcatcatcctgaaattggtaacgctataaaataatagcgagctaattatgaggtttgatatatgaaactttttctgacaacagcagcgctaactgcgaccttgatttccggcatggcatttgccagcgatcccgtcatcccctgggcgactaacagcggcggtacggaaagcacgcatattgcggcaatgggcgaggatttgaatgcgcagcatcagcagatcacccacacgcatgaaggcgtatgggcggctaattccggcagcattcaggctgatgaagctgcgctgaccagcaacaagccgccggtacaaggccatccggaattaatgccgcatcagggctaatgatcatggcctggcgataacgccaggcgcttacgggttattcggcgacctgccactgtgcgtctggcgcaaaacgcgtgatagcctgaactttactctccgtctccttgcctaaatccgcctgataaatacgatcgtcctggttgaccataaaactcatcaccccggtttcgccgtaatgcatcggccaggccagaagcgccgcgccgtgaccgtcgttatcgctgataatacggaaatggtagccgtggtaaccctcgtctggcgctgcgggactaaagtttgggcctaacggactggggacgtcgcctgctttggttggccagtacaggccatctttttggccttcgctactgattatcctgtgcgcccagcgatggttttgtaagtaataatcctgctgcgcatcaacgtaagcatgcatggcctgtaaggtagaaagttcatttcgcccaatagtacgggtgaggatctcattcccggctgccgccatatcaaagcgccagccgccagtctctttcaccatgggcaccgggagctgccagtcttctcgtccgacattcaggtgcgccgtattgtctttttgtacaatgcgatggccttcgcgccagtcacgattgaagcgggccacggcctcgggatcggcaccttccggcggcagaaattgccgccagtcatcgcccagtagcgcggtaagctgcgtttcgttttttccggctaccgccgcggcgaaggcgctggcggccgcttccggggaggggaaccgttcctgcgcgtagcccagcaagggtaacgacagtaacagagcgcttaacataacctttttcattatctgctccggttaacggcgatgaaattcatgatgttcagaaaaatgttcccgcgcggcggcgcgttgctcggtgtttaagtgactgccgcgacggctttccaggccgcgtagctgttgcgattgccatgacggcgatcgactgtcgttcccgctaaacacattggcgtgcatattctggcgaaatgcctgacgctgctgcggcgtagaggattcaatacgctggcgggcggtgtctctctgctgttgtgaaacagggtgctgctgggctttagccttcagctcggaacgatgctgctgcgtggtggatttattcagtgtctgctgcgccgcctcgcgacgactgctgttttgtgttccgtcatagccacggtaattattacgctgggcaatttgatttaactgctgcgatgccgccttacgctgggcatcgcgggtgcctggcgctggcaaagaagcgttggccgtatggctgcgctgttgaaattgcgtcatggccgcctggcgctgactgtcgcgagacactggcgcttgctgcgttgcgcttaacccgccgctaacattggtgggatggaaccgttgcgcaacggtattattcggataggggacgccattgcgccaggcgggattatgctgccagcccatcgtttggcccggcaggttttgcccggatatccggttgaaattattgacattgatgttgatattatcgccattatgttgataaccgttaccaccatgatggtaatcatcatcatggtggtcgtcgtcatggtggtgatgatcgtcatcatcccagtctatgctgctgaacaacgcataggtggtggcgacgcccagactataaccaaaacctttaacaaaactgtcggcaaactgctgccccggagggggcggtaaatacaccggcggataagcggtattgggccaggcgccatacaccgtcgcggggttatagttcggcacgtacaccacctgcggattcgcgggttcaatttttataacggtcgacggtgtcgctggcgtactggcggatgtggtggttgtcgtcgtgacggcggtagaagcgctggacttcggcacgctggtgacggtttgctgtggcgtggattttagcgaaccggtttgttgagcgagcagacgcagcctttgcaccgcatccatcacatcctgtggctgggctaagaacgcatcgcccaggttttgcacccattgcggattctcgcccataagcgccatcaactggggaaaggcgaccagcgatttgacgctggggtcccacggttggctggccaccgcctgaatagcggcatcgccctgcagcgtagggttatcgcgcgaccactggacggcctgaactacgttcgccgggtaggtggaggccatgagcacctgcgaaagcagggcatcgggataaagcgcaacaggcgcgacccattgatcaatttgcgcagtggtaaaggtcgttttcgcgacaggcgcgggcacagcggtctgcgttggctcagaggcgggagctgccgcctgcgcgggcgcttcgggagcgcggcttttaacatacagtacgcccgaagcggcaaataacccggcactgcacacaagggcaatgagatggggtttaaagggcaacgtcattttatctctcccgattccagagaatcgctatggtcattatgcctgccgccgacggggtgcagtttggcgtgagtataaagggacgatagtttaatttttagctaatgttgggatcggtaacgttacgtgacgatcaaagcacgaaatgaggtaagcatttatggctgcagctcccgtctcagtagagcattagaccatccttaacgattcagccacttttttatgttgcttttttgtaaacagattaacacttaaagaaaatcctgttattgtgccttatgcggtaccgggcatttaccctactaactactgtctcacaggagcgtgaagagaatcgcccatcaacaaaagcgccgcattatgacaatgagagcgaggagatatcgtcgtgctagaagaataccgtaagcacgtagctgagcgtgctgcccaggggattgtgccaaaacctttagacgcaacccaaatggctgcgcttgtcgagctgctgaagaccccgcctgtgggcgaagaagaattcctgttagacctgttgatcaaccgcgttcctcctggcgtagatgaagccgcttatgttaaagccggttttctcgctgctgtcgcgaaaggcgacaccacctccccgctggtctccccagaaaaagccattgaactgctgggcaccatgcagggtggttacaacattcatccgctgattgatgcgctggacgatgcgaaactggcgccgattgctgccaaagcactgtcccacaccctgctgatgttcgataacttctacgacgtagaagagaaagccaaagcgggcaatgaatatgccaaacaggtgatgcaatcctgggccgacgccgaatggttcctgagccgtccgccgctggcggaaaaaatcaccgtcaccgttttcaaagtgaccggcgaaacgaataccgacgatctctctccggcgccggatgcgtggtcgagaccggatatcccgttacatgcgcaggcgatgctgaaaaacgcccgtgaaggcattgagccggatcagccaggcgttgtcggcccgatcaaacaaatcgaagcattgcagaaaaaaggctacccgctggcttacgtgggtgacgtggtgggcaccggttcttcccgtaaatccgcgaccaactccgtgctgtggttcatgggcgatgacatcccgaacgtgccgaataagcgcggcggcggtctgtgcctcggcggcaaaattgcgcctatcttctttaacactatggaagatgcgggcgcgctgccgattgaagttgacgtttctaacctgaatatgggcgatgtgattgacgtctacccgtacaaaggcgaagtacgcaatcatgaaaccggcgagctactggcaaccttcgaactgaaaaccgacgtgctgattgacgaagtgcgtgccggtggtcgtattccgctgattatcggccgtggcctgaccaccaaagcgcgtgaagcgctggggctgccgcactcagacgttttccgtcaggcaaaagacgtggcggaaagcagccgtggcttctcgctggcacagaaaatggtcggtcgcgcctgtggtgtgaaaggtatccgtccgggcgcgtactgcgaaccgaaaatgacctccgtcggttctcaggatactaccggcccgatgacccgcgacgagctgaaagacctggcctgtctgggattctccgccgatctggtcatgcagtcgttctgtcacaccgcagcctatccgaagccggttgacgtcaccacgcaccacacgctgccagacttcattatgaaccgtggcggtgtctctctgcgtccgggcgacggcgtgattcactcctggctgaaccgtatgctgctgccggataccgtcggtaccggcggtgactcccatacccgtttcccgattggtatctctttcccggcgggttctggtctggtggcgtttgccgccgcgaccggcgtgatgccgctggatatgccggaatccgtgctggtgcgcttcaaaggcaaaatgcagccgggcatcaccctgcgcgatctggtacacgccatcccgctgtacgccatcaaacagggcctgctgaccgttgagaagaaaggcaagaaaaacatcttctctggccgcatcctggaaatcgaaggtctgccggatctgaaagtcgagcaggcgtttgagctgaccgatgcttccgccgagcgttccgctgccggttgtaccatcaagctgaacaaagagccgattgttgaatacctgacctccaacatcgtcctgctgaagtggatgatcgccgaaggctacggcgaccgccgtacgctggaacgtcgtatccagggcatggaaaaatggctggcggacccgcagctgctggaagccgatgctgacgcagagtacgcggcggtgatcgacatcgatctggcggatatcaaagagccaatcctctgtgcgccgaacgatccggacgacgcgcgtctgctgtctgacgtgcagggcgagaagatcgacgaagtgttcatcggctcctgcatgactaacatcggccacttccgtgcagccggcaagctgctggacaaccataaaggccaactgccgactcgcctgtgggtggcgccgccaacccgtatggacgccgcgcagctgaccgaagaaggttactacagcgtgttcggtaagagcggtgcgcgtattgagatccctggctgttccctgtgtatgggtaaccaggcgcgtgtggctgacggtgcgacggtggtttccacttctacccgtaacttcccgaaccgtttaggtaccggtgcgaacgtcttcctggcttctgcggagctggcggcggttgcggcgctgatcggcaaactgccgacgccggaagagtaccagacctacgtggcacaggtggataagacggcggtggatacttaccgttacctgaactttgaccagctttctcagtacaccgagaaagcagatggcgtgattttccagactgcggtttaatttacattttaagggggctaattgccccctttttattcatattatatgtttctgtattttctatctttttaagatgttgcgtatttttattttagcttcttcatattgtaggttttcctctcttaagtatatatgaacagctttgtgacaatttgggcaaagtaatgcaaagtcagttttcaatattctgtgctcaccggtaaaagtatgtattggtattttgtggtgggcctcaatatagtttttaccatatttatctaagaatttaatctcacaaatatcacaaacccattgcgagttatcttttatttcatctattatttttctattccgctcagataacatatgagttatgtatttaatttttccttcagtgtgctcgtttttatacaaaatgacgtcatcattgtcactattcttatcatttagacttgggaaacttatcattttttctaagatgactgctttttctagtatgtctatgattttaaagcatccctgaaattcccatttgttagatgaatcagtaaataacaaaattggatagttgcttatcggttggttaattagaacccggttcgcagaatcattaaagttaatgatgccttttgctgctttaaatgagtaagagtatatggttttttcattatttttccagccatcatcagcgtaagaaccatcctttgtttttattattactgctttgatattgggatgttctcctatccaatttattccttgttgaggtgtgtttttaattatccaatccttgccttcccaattttcactgtcatcttttttagatttttggatgagctgggataaattttgtttgttaattatatctgagatagttaatgaaagaagttgagatggatattgaataagctttaaggttcccattatattcctatactataaagtgtataataattatcattatacatgctagcagtgtaaatttactacattcataatgatagcatgggacgatgctacttgtggaaccagaatgcagataacccgatcttcttattgataaatttacgacaattagacgtatccactttttttcctctacatagctgcgataattacccataggtacaatgcagcggtgacgcattgcctttgtagaggaacagatcatggattacgaatttctgcgcgacgttaccggaggggtaaaagtacgaatgtcgatgggccacgaggtggtcggtcactggtttaatgaagaggttaaagacaacctctcgctactggatgaagtagaacaagccgcgcgtacggtcaaaggcagcgaacgctcctggcaacgagcagggcatgaatacacgatctggatggacggcgaagaagtgatgattcgcgccaatcaactggatttttccggcgatgagatggaagaggggatgagttattacgatgaagagagtttatccctgtgcggcatggaggattttctgcgggtcgtcgccgcgtatcgggaattcgtcagtaaagcctgaccctctcttcgttattgtcccacaacgccagtcgacggacagttgggggcggtagtggaaacgaagtcgccaaacattccagccgggagtatcccggcttttttatagcagaatgattttttgatttttattaatcattttaaaactgtgatctgacgcgtttgtgatcttaatttgattgaatataatcgttatgattttattcaatcacaacaagcaacaggcggtaagaccatgaacatcaaaaaagcaatagagcgcgtacccggcggcatgatggtcgtaccgctcgttattggcgcagtcattaacaccttcgccccgcaggcgcttgagatcggcggttttaccactgccttatttaaaaacggcgcggcaccgctgattggcgcttttctgctgtgtatgggagccggtatcagtgtgaaagccgcgccccaggcgttattgcagggcgggacgattacgctcactaagttgcttgtcgccatcggcattggtctgggcgtggagcatcttttcggcgcggagggtatttttggcctgagcggcgtggcgattatcgcggcgatgagcaattcaaatggcggactttatgctgcgctggtaggcgaattcggcaatgagcgcgacgtcggcgctatctctattttgtctcttaatgatggccctttctttacgatgattgcgctgggcgcggcagggatggcgaacattcccattatggcgctggtggcggtgctggttccgctggttgtcggcatgatcctcggcaatcttgatcctcatatgcgcgattttttgaccaaaggcggcccgctgctcattcctttctttgcttttgcgctgggggcgggcatcaatctggaaatgttactgcaaggcggacttgccggaattctgctcggcgtgctgacaacgttcgttggcggtttctttaatattcgcgcagatcgtctggttggcggaactggcattgccggggcggcggcctccagcaccgcgggtaatgccgttgcgacgccgctggctattgcgcaggccgacccttcgctcgccgaggtggccgctgctgccgctccgctgattgccgcctcggtgatcaccacggcaatcctgacgccagtgttgacctcctgggttgcgaaaaaacaggcgcgtcaggcttctttggagaaaaacgcatgaaaatgatagttatcgccgatgattttaccggatcgaatgataccggcgtccagttggcgaagaagggggcgagaacggaagtcatgttgagcgcgtcgcaaaaaccgtcccgccgcgccgatgtgttagtcattaacaccgaaagccgggcgatgcccgcagatcaggcggcatctgccgtttatgccgcgctttcgccgtggtgtgagacatcgccagcgccgctggtgtacaaaaaaatcgactccacatttcgcggcaatatcggcgccgaagtgacggcggccatgcgcgccagtcagcgaaaactggccgttatcgccgccgcgatccctgcggccggacgcacgacgcttgaaggaaaatgtctggttaatggcgtcccgctactggaaaccgaatttgccagcgatccgaaaacgcccattgtctcttcccgtattgccgagatagtggcgttgcaaagtgagatccctgtgtatgaagtctttttgcaggatgtccgacgcggcgggttaagcgccttacttacggcttatgcggctgagggcgaagggattatcgtcgtggatgcggtggaagagcgggacctgacgttgattgcgcaagcggcgtgtgaacaaccgtcgatgccgctgctcgtcggcgcagcgggtctggcgaatgcgttgccggttgaactttttatgcaagaccggcagcggctgccggtgctggtggtggccggttcgatgagcgaagccacgcgacgtcaggtggataatgcgctgtgccggggacgtgcggaggtcgtggatatcgatgccgcgcgcatggtgtcggatagcgcggaacaggaaatcgcgtctgtcgtagagcaggcctgcgcgctgttaagtcagcatcgacatacgattttacgcaccagccgtcgcgcagaagatcgacagttaatcgacgcgttgtgcgaaaaatccgcgatgagccgtcagcaattgggcgagcgactgagccagcggcttggcgtcgtcacgttaaacattatcgagcaggcgcggattggcgggctgtttctgaccggcggcgatatcgcaaccgccgtcgccggcgcgcttggcgctgaaggttatcgcattcagagcgaggtggcgccctgtattccctgtggaacgtttgtaaacagcgaaattgacgatctgccggtcattaccaaagcgggcggattcggttcagacagtacgttgtgtgacgcgctttattatattgaggagatgtattgtggagactaaaaccgttgccattaccatgggcgatccagcgggcattgggccggaaattattgttaaagcgctaagcgaagacggtctcaacggcgcgccgctggtggttattggatgcctcgcaacgttgaaacgtttacaggcgaagggcatcacgccgaacgtcgagttacgggccattgaacgggtcgccgaagcgcgttttgcgcccggcatcattcatgtgattgatgagccgctggcgcagccggaggcgctggaggccgggaaagttcaggcgcaggcgggggatttagcgtatcgctgcgtgaagcgcgccaccgagttagcgttacggggcgacgtacaggctatcgctaccgcgccgctgaataaagaggcgctgcacctggcggggcacaactatccgggccataccgagctgctcgcgaccctgacccatagccgcgattacgcgatggtactttacaccgataaactaaaagtgattcacgtttcaacgcatatcgcgctgcgtaaattccttgatacgttaagtaccgcgcgtgtcgaaacggtgattggcattgctgatactttcctcaagcgtgtgggttacgttaaaccgcgtatcgccgtggcaggcgtgaatcctcatgcgggcgagaatggcctgtttggcgatgaagagacgcgtatcctgacgccagccattaccgatgcccgcgcaaaaggtatggacgtttatgggccgtgcccgccggatactgtatttctccaggcttatgaggggcagtatgatatggtggtggcgatgtatcatgaccaggggcatatcccgttgaaattgcttggcttttatgatggcgtgaatatcaccgcggggctgccgtttattcggacctctgctgatcatggcaccgcatttgatatcgcctggacgggaaaagcaaaatctgagagcatggccgtatcgatcaaactggcaatgcaactggcataattccctgttatgaaaggacaacaccgtctggatctcattgtggcgtatctgaaaaaccatacgctggttacggtagaacagctggttgaggcggttgacgcatcgccagccactatccgtcgcgatttgatcaagctggatgagcagggcgtgatcagccgtagtcatggcggtgtggcgctgcgacgttttgaacccgcccagcccaccaccaatgaaaaacaactgcgatcgcccgctgaaaaacgggcgatcgcacgcgttgccgcatcgctggtcaatgctggcgatgccgtcgtgctggatgccggtacgacaatgatggaactggcgaaatgcttaacccatcttccgctgcgggtcatcaccgtcgatctgcatattgcgctgtttttagctgagttccggcaaattgaagtgacgattgtcggcggtcgtatcgatgacagcagtcagtcctgtatcggtgagcatgggcgcaagctgttgcgcagcgtttacccgaacatcgcgtttatgagctgtaattcatggggggtaaaaacgggcgtgacgaccccaacggaagataaggccgggcttaaacaggagattattgctaatgcgcagcgcaaagtgttgctggcggacagcagtaagtatggcgcgcattcgctctttaatgtggtgccgcttgagcgctttaatgacgtgattaccgacgtcaatctgccgccgtcagcgcaggttgaactgaaagggcgcgcttttgcgctaacgctggtgcagccggagtgacagcgccgtcaggcgctgccagtggtgaatcagaccgcagaaatattgcggccgtagtaaatctcgcgcatctctttccacagcgcggcggtgatctcctggcgttcggtttcagtgagatcttccggtttggtgtgaaacatgtagtgcttaagatcgaactctttaagcagcatcttggtatggaaaatattttcctgatacacgtttacatccaccatgtcatacagcgacttcatatcttccgacataaaattctgaatagaattaatctcatgatcgataaagtgcttcataccgttgacgtcgcgtgtaaagccgcgcacgcggtaatcgatggtgacgatatcggactctagctggtggatcaggtaattgagcgcttttagcggtgaaatcaccccgcaggttgacacttcgatgtcggcgcgaaaggtgcatagcccgccttccggatggctttccggataggtatgcacgcagatatggctcttatcgaggtgcgccaccacggtttccggcagcgggccgggatgttcggtttgatcgataagtttcgggtcgatcggctcttcgctcaccagaatcgtgacgctggcaccctggggttcataatcctgacgggcgatgttcaggatgtttgcgccgataatggagcaggtctccgacaggatctcggtcagtcggttggcgttatagagttcatcgatataggcgatatagccatcgcgctcttctgcggttttggcgtagcagatatcgtaaatacaaaaactcaggcttttcgtcagattgttaaagccatgcagtttcagctttttcaatttttatcacctccttaacgtcactgtgcggacagtgcgtcatgtagatattgcggtagcgcaaatgcagcggcatgaatagccgggttgtaatagcgacatttgaggccggcggcatgaaaacgtgcctgaataatttcgctcgacaggtggcgaagagcgtcgttgtccgtcgcccaggcgaaggtcataatgccgccgtaataggtcggaatcgccgcctggtagaagccgacatcgctgaagtaatgactcagcttgcggtggctgtcgagcgcttcatcctgctgcaggaagcacacgccgttctgggcgacaaaaatgccgcccggattcaggcaacgcttacagccttcataaaaggcggaggtaaacaggctttcgccggggcctatcggatcggtacagtcggaaatgatcacatcaaaggtctgatgggtttgattgacgaaattcacgccgtcgtcgattaccagcgtaaagcgcggatcgtcgtagctgccggcattgtggttgggtaaatactggcggcaaaacgagactacgccagcgtctatctctaccatggtgatggtttcgacgtttttatgccgggtaacttcacgtagcattgcgccgtcgccgccgccgataatcagaacgtgtttcgcatgaccgtgcgccagcagcgggacatgggtcatcatttcatgataaataaactcgtcgcgttcggtggtctgtaccacgccgtccagcgccatcacgcggccaaaagcggcgttttcaaagatgattaaatcctggtgatcggttttttcatgatacagaacgttgtctacggcaaagtactgaccaaactggtcgtgtagcgtttcatgccacatcgtattttcggccattggctgatacctccattgttaacacccgtaaaaaaagggcgcaacatcatagctaacaatgaccgtggatgcacggtcattatttcagcaataggatcacggaggattatttaacgtaggctaacaggctcagagaatcgcgggccagagctttgcattttttagcgaccggaataccgatgccgctaagatcgcggtagctgtcttcgcccaacgatttcatatcgaaggtgtcgtagttactcaggtcccactgattttgctgggcaaaaaagaccagcgcacggcgaatctggctgttgggtaaattttggtaaccacagtcatttttcagaaaaacgaaaactgccgttaaatcggccatatcttcagcttcggattcagtaagcgcatagctatttgcgcataaggccatcaggctgccaaacaacacgggtctgaaaaacgtcttcattgcttctaccacggcatcagggaaagtcaacgttagcatactgagaacgtagcgacgacttttattatcaggattggtcgcggcgttttcattcttattgtattgctgtcaggaatggtaaagacgtgttgctggcttgaccttcccgttagggcagggtctaagcttagacacccgcctgttcattataaggaaatgattatgttacgccgtgatttcttaaaatattcagtggcgctgggggttgcatcagcgctgccgctgtggagccgcgccgcttttgccgccgaacgtcccgcgttgcctattcctgacctgttaacggcagatgcgagcaaccgtatgcagttaattgttaaagccggacagtcgacattcgccggtaagaacgcgacaacctggggctacaacggtaatttgctggggccagcggtacagcttcacaaaggaaaaagcgtgaccgttgatatccataaccaactggccgaagacacgacgcttcactggcatggtctggagattccgggcatcgtcgacggcggcccgcaggggattattcccgcaggcggaacccgcacggtgacgtttacgccggagcaacgcgccgcgacctgctggattcatccgcacaaacacggcaaaaccgggcgccaggtggcgatgggccttgccgggctggtgctgattgaagatgacgagattcgcaaattgcgcctgccgaaacagtggggcatcgacgatgtgccggtgatcattcaggacaaacgcttctccgccgatggccagattgattatcaactggatattatgaccgccgccgtcggctggtttggcgatacgctgctgaccaatggcgctatctatccgcagcattccgcgccgaaaggctggctacgtctgcgcttgctaaatggctgtaatgcgcgctcgctgaatatcgccgccagcgataatcgcccgctttatgtgatcgccagcgacggcggcctgctggcggagccggtgaaagtcaccgaactgccgttattaatgggcgagcgttttgaagtgctggtggatatcagcgacgggaaagcctttgatctggtgaccctgccggtcagccagatgggaatggcgatcgctccgtttgataaaccgcatccggtgatgcgtatccagccgctgcggattaccgcctccggtacgctgccggatacgttgacgacgatgccggcgctgccgtcgctggaagggctgacggtgcgcaacctgaaactgtcgatggacccgcgccttgatatgatggggatgcaaatgctgatgaagaaatatggcgctcaggcgatgagcggcatggatcatgacagcatgaacgcgcatatgcagggcggcaatatggggcatggcgagatggatcatggcaacatggatcacagcgggatgaatcatggcgcgatgggcaatatgaatcacggcggaaaattcgacttccataacgctaactttatcaacggccaggtcttcgatatgaacaaaccgatgttcgcggcgcaaaaaggccgacatgaacgttgggtgatttccggcgtgggtgacatgatgctgcatcctttccatattcatggcacccagttccgtattttgtcagagaacggcaaagcgccagcggcgcacagaacgggctggaaggatacggtacgcgttgagggcggtatcagcgaagtgctggtcaagttcgatcacgacgcgccgaaggaacatgcctatatggcgcactgtcatctgttagaacatgaagatacgggaatgatgttaggatttacggtctgaccgatgtctgtgacgcaggccgggtaaggcgaagccgccacccggcacaatgcccggcatacgccgggcattaatggttatttcgcgtcgtcaggcaaagcataggccacgatatagtcgcccatcttcgtaccaaacgaaccgtggcctccggcagaaacgaccacgtactgcttaccgtttacctcataggtcataggcgttgcctggcctccggcgggtaaacgtccctgccacagtttttccccgttgctcatgttataagcgcgcaggtagttgtcggcggtcgcggcaatgaacagcacattaccggcggttgagattggcccgcccagcatgggcatccccatgttgaacggcaccggaaccggcatcgggaacggcatactgtcgcgcggcgtccctatacgtttcttccacacgatttcattggtcttcagatccaacgcggaaatatagccccaggccggttgtttacacggcaggccaaacggcgaaaggaacggattcagcgtgacgccgaatggtacgccgtactgtggctgaatacccgcttctgtaccggtacctttcgcgtctttcggcggctccattggattacccgggccgcgtgggatcagcttcgagacaaacggcagcgccatcgggttagcgatagcgacctgacggtctggatcgacggaaataccgccccattcaaacatccccaggttgccagggaataccaatgtcccctgctcggacggcggggtgaagataccttcatagcgcaactggtggaacatgacgcggcacaccagttggtcgaacatggtcgcgccccacatatccgcgccggagagatcttttttcgggcggaaggttaaatcagagaacggctgagttttggcgacgtaatcgccttttgccgcgccctgcgggaccggtttttccggggcgggcacgaccagctcgccattacgtctgtccagcacaaagatattaccggttttcgctggcgcatagataaccggaacggtagtaccgtcaacggtaatatccgccagcgtcggctgtgccggcaggtccatatcccacagatcgtgatggacggtctgataactccaggccagtttcccggtggtggcattcagcgccaggatggagctggcataacgctcctgctccggcgtgcggttaccgccccagatatccggcgtggtcacgcccatcggcagatagaccagatccagtttcgcatcataggcggcaggcgcccaggagttcggcgagttaaaggtaaaagcgtgctcatcggctggaatcgcgttcggatctttcgcccccggatcgaaggcccacatgagtttaccgctattaacatcaaaacctcggataacgccggacgtttcgcgggtagagaagttatccgtgaccgaaccggcaatgacaattgttttatcggtgataatcggcggcgacgtcggttcatacagtcccggtgtggtatccggcatattggtttgcagattcaggacgcctttgttggcgaaggtttcacacagcttgccggtttcggcattcaccgcgaaaaggcgaccgtcgttgaccgggaggataatacggcgcggacagtcggcgatgacctccggcgaggcggtatccgctttggcctcatgataagagacgccgcggcaggtcacatgctggaaagacgaatcggtcttcaactgaggatcaaaatgccacttctctttaccgctggcggcgtccagcgcgaacagacgctggtgagctgtacacagataaagcgtatcgccgacttttatcggggtcacttcgttggtgatttcacccggatcgttgggctgtttcagatcgccggtgcggaagacccacgcttctttcagttggtgaacgttatccgcagtgatctgtttcagcggcgaatagcgttggccttcctgattgcgcccataggccggccagtcttcgtcggcgatcgacgaacttgttgcggcgggcgtggcgtcggcgcgaagcgtaccgttgatctcctgcgggtcgttgaagccggcccaggtcagaatgccgccgctaatcagcaacgccacgaccagcgccgccactgcgccactggaaggaaccaccagccgatgccagacaaacggtaatattagccagatgccgaaaaacaccaggatatcgctacgcggcgtgagcgcccagaagtcgaacccgacttcccacacgccccaaatcattgtcgccagcagcagggcggcatacagccacagtgcggcacgtttactgcgccatagcaatccggccacaaccagcatcacgaggcccgcgatggggtagtaccaggaaccgccaatagcaaccagccagacacctccgataagaagatacagcccacaaagtgctgcaaagagggccgtcagcgtcacgagtaatcgtggcgatcgtgcgttattttctgccataaaaagacaccatcccaaattgttaattttttagtagcaattaagtataggaattaacatgtgtgatcgtcatcacaaaatgagctttcttatcaaatgccgcgaatgaatacgtttgctgttatactgcgtgccttgcgcgtcaatgcggcgttattagtcaccggcattgagtgatttgtttttaaatcatatggttataaatatgaaacatactgttgaagtcatgatccccgaagcggagatcaaagcacgtattgccgagttgggtcgtcagattaccgaacgttataaagacagcggcagtgaaatggtgctggtaggtctgttgcgtggctcatttatgtttatggcggacctgtgccgtgaagtccaggttcctcatgaagtcgattttatgaccgcctccagttatggtagcggcatgtccaccacccgcgacgtgaaaatcctcaaagatctggatgaagatattcgtggtaaagacgtgctgattgtcgaagacattattgattccggtaatacgctgtcgaaggtccgtgaaatcctgggcctgcgcgagccgaaatcgctggcgatttgtacgctgctggataaaccttctcgccgcgaagtggacgtgccggttgagttcgttggcttttcgattccggacgaatttgtagtcggttacggtatcgactacgctcagcgttatcgccatctaccgtatgttggtaaagtggtgctgctggacgagtaagcgcagaaatgccggatggcgtcgctaaagcgacttatccggcctatagctaatggcttattggtggggaatgtatttcagacttagggcggaaatacccttatgatagccgttctccagcgtttctctgttggtggcggtgacgtcaagatcgcgcagcaggccatcattgatactgtacgcccagccgtgaatggtcacattctgaccgcgtttccacgctgactgcataatggtggaatgccccaggttatagacctgttccatgacgttcaattcatagagcgcgtccagacgttgctcttcgggcatttttcccaacagcgagctatgtttaagccagatgtcgcggatatgcagcagccagttattaatcaagcccagctcagggttttctaccgcagccttgataccgccgcaaccggagtggccgcaaatgataatatgctcaacttccagaacatctaccgcatactgaaccacggagagacagttcagatcggtgtgaataaccaggttagccacattacggtgaacaaacaattcgcccggttcaagcccggttaaacgctctgcgggaacgcggctgtcggaacatccaatccatagaaagcgcggtttttgcgcttgcgccagtttctcaaaaaatccggggtcctcttccaccagcatttttgaccatagtgcattgttgctgatgagtgtatctatgtctttcatggaagttaacgacctgtaaccaaataagtgcgttgggctaatatagggcaactccgtaattatttaaaccatatataaagtgtaagaacgtaaagtaagtgagaatttatgaccattgcgctggaacttcaacaacttaaaaaaacctatcccggcggcgttcaggcgttgcgcggcatagatttgcaggtcgaagcgggggatttttacgcgcttctggggccaaatggagcagggaaatcgaccaccatcggtattatcagctcattggttaataaaacgtccgggcgcgttaacgtttttggttacgacctggaaaaagacgtggttaacgccaagcgacagcttggactggtgccacaggagtttaactttaacccgtttgaaacggtgcaacagatcgtagtgaatcaggcgggttattacggcgtggaacataaagaggcggttttacgtagcgaaaagtatttaaaacagctcgatctgtgggaaaaacgtcatgaacgcgcgcggatgctctccggtgggatgaagcgccgcctgatgatcgcccgcgcgctgatgcatgagcctaaactattgattctcgatgagccgacggcgggcgtcgatatcgaattgcgtcgctcgatgtggggattcctgaaagatttaaacgccaaaggcaccacgattattcttaccacccactatctggaagaggcagaaatgctgtgccgcaatatcggtattattcagcacggcgagctggtggaaaatacctccatgaaaaatctgctttcaaagctgaaatcggagacgtttattctggatttagcgccaaaaagcccgctacctaagcttacgggttatcaatatcgtctggtggatacctcgactctggaggtggaagtgttacgcgagcagggggttaacagtgtctttagccaactgagcgagcagggggttcaggtattaagtatgcgtaataaagccaaccgtctggaagaactgtttgtgtcgctggtgcatgaaaaacaaggagatcgcgcatgatgcagctttactgggttgcccttaaaagcatctgggcgaaagagatccaccgctttatgcggatctgggtgcaaacgctggtgccgcccgtcatcaccatgacgctctattttattattttcggtaacctgattggttcgcgcatcggcgaaatgcatggttttagctatatgcaatttattgtgccgggcctgattatgatggcggtcattactaactcctacgcgaatgtcgcgtcgtcattttttagcgccaagtttcagcgcaatattgaggaactgctggtcgcgccggtaccaacgcacgtgatcatcgccggatttgtcggcggcggcgtagcgcgcgggctgtgcgtagggattctggtgacggcgatttcgctctttttcgtgcctttccaggtgcattcctgggtatttgtcgcgctaacgctgattctgaccgcgattctgttctcgctggccggactgctgaacgccgtgtttgcgaaaacctttgacgatatcagtctgatcccgacctttgtgctgacgccgctgacctacctcggcggggtattttactcgctgacgctgctgccgccgttctggcaagggctgtcgcacctgaacccgatcgtctacatgatcagcggtttccgttatggttttctgggtatccatgatgtgccgctggtgacgacgtttggcgtactggtgatctttatcgctgctttctatctgctgtgttggtcgctgatccagcgcgggcgcgggttgcgcagttaagcgctgactggggagatggggcgttgggttgcgcttcgcttcacttcatctacgggtccgtaatatcaatgggttacgggtcggtaggtgaggcttgtcgaaacccaacgcttctctcagcgaatctgaatctccagcgtggcggtggcctggtattctccggtgtggggaacatgtccggtggtattgaccggcgcggcggtgaactcggtgctgcctctaccgtcagtgtaatcttcaatcggcaattcggcgctgccgccgggaacgatggtattatcgtatttatcggaaatccgtatccccaaattctcattgtcagttttcaggtagtccgggttgtgcggatcggttgcgccatttaatgacattgacaggttggtgccgtccgccacgttgctacaggtaaagtttacctgagtggtgacgtgcgagttctgcgggctgtcgccgaggtgacgaatatctttgccctcaatatccggtagcctgacctcgataacctgcccggcgttgatggagcaggactgcggcacggtaatggtcccggacatggtgacgtgcgccatcggtggaacggaagggggaatattatctccgctgctgcccggcgtttttgacaaatagagattcataatcgtcgtctcaggaatggtgatttcacctaccaatgggtgagtaatataaatacgcacgttacccttattccctgcggacattttgtttatgtccgcgcccgtacacccgcctgcggtggggtcctgattactgatcgctgaaaagggaacggggatatactgtttcaggttaccgacgatgtaggtttccgtaccaatctccagcttacccgcgaccagaacataaaaatccatctgttgcccattgctacccgcttcgctgtacgttcctttttgtgttaaatcgccggtcgtggcggtgaaatagttaacgccctgataatctttattatcgcagtcgcacctggcgctgtattcgccgccgaccgaccaactctctttgactattttccctgcctggttctcatccgtatcggtaatggtctggtcaaggggaaaaaagaaattatgcgtgccgctggtgggttgacaccagccgcttccgttgcccatcgttccgtctgccagcgcatggcctgaaaatagcgatagcgccagcagcatccataaattcttcattgtgttcctcactggcagacggcgttcgccatcactatgccgttcatatttttgctgatatccaggcggtaatccgcgcggcaagaggcgcttccccagttcaccagcagcaggccctcttccggcaggccgctgaggaagacctggcctttatcgccgacgatactggccaggttcgcatcctgcccatcgacgcttgccgtcgcgccaaagggcacgggctcgccattgctgcgcgtcagcgttaacaacacgcgatagcccttatgcgtgtcatacgccgcgcgcaccaccgcattacgcgtcgggtagacggtctggttgttgagcggaatatccacgttgtcagcaaacgtgctgctgtcgagcgagatatcgtagcgataatacggcgtgacgttggggatcaccgtataaccccggaagtcggtggcgacgccggtctggttttcaaccgaaacgccgctggcgccgggcgctttaattaaaatcgccgcgccggtaatcggctggctcagggtaataccgttttcgtgcgccagaatgccgccgctgatgccgtagctgacttgttggctatctggcgactgattgtaaccggcgttgaggttggcataagtgcctttatagctggcgtttaccccgccggaatcaccgtcttgtgtgctgtggctttgctgtaacgaccagttcaggtttctgtcacgcagcgcggtgccgctaagggtggtgctgttcaccgtggcatcgtgcttacgcgtgttcagcatatagctggcgtatagcctggaatcgaacaccgtaaacggaacgtgcagcgacagcgtgaacagccgatcgttctggttataacgatcgtcgtcgttgtcatcatcgtcattgtccgaacggtactggtaggtgtttttgttatagctgtagctcagcgtatagctcaccggaccccagctattgttgtagctggcgctcagggattccatctgctgcgcgctgtgccagtaatcttctttgacccaacttagcgttaaggaaccgagcgtattgctaatttgctggttgaccgaagcttcgaaacgattatggcgcttgccgtagttatcataaaaatcgtcgtccgggttgatcacctcgctcagcgaattgtagttttcgctggcgtaacgatagccggccagcgaaaacgtggtgcccgtactgacgacgcccttgctgtagcggacgtgccaggattgcccgatttctttgcggccatcgtcaaatttggcgtgcgaccagatgccgtccagggaaatggcccccagcatctgcatattttgcccgacgccgaaggcgacggactggtatttatcgccggcaatctggctgccgccgtacagggtgatgccccacggcaggccgtacagcagggtcgcctggccgaagtcgtccagcgcgtggttgttataatcgcgatatttacccacggtcacgctgtattttgcccgtccggtgcgctgcagaatcggcagcgaagagtagggcacgataaaatgctgttcgctgccgtcggcttcttttaccgtcacgtcatagtcgccgttgctgccggtgggaaacatatcgttgatttcaaattcgcccggcgaaacggcggtctgataggcgatatagccgttttgccgcacgataacctgcgcgtttgagcgggcgatgccgcgaatcgtcggggcgtaaccacgctggctgttgggctgcatttgatcgtcagaggtgagctggaggccgcgaaaaggtacgctgtcgaacacgtcggatggcgtattgctgtctccggcggtgaactggcttttcagcgcgataatgtcgcgctgtaaatagttataaacgctgttccagctaccgttctcgccgttatttgaactccagttactgtagttgcgaaaacgccacggcccgaggttaaaacccggctggagagcgagatacttcgattccgcatcgtcggaatcctcactggaaccgtactctttatagccgctgaagctgtagttcagcatcagcgcggtaatcccctcctgccacttttccggcggtacgtagccgcgtgcgttgttggcgatgtagagttgcgggatgcttactgataatgcctgttgctgaaaatcaaaccgctggctggcgccggggataacgctgagatcgacgcagcctttttcactctccagcgttggaaaaaggtcggttttgacgccgttatcttttagttcctggagccgtaaacagccctgtaatgcctgttgaccgtcactgagcgtcgcgagttgaaaatcaacgtttcgtgcgccgatttctgttttattgatattgatagtgacgtaataggtgccaggcagctggcttttgtcgttatcaaatgtcgacagatcgacgcttgtgcgattcgcctgcccatggttttcaataaatgccggattgaaatagtcgcgcgcccatgcaacgtgtgtgaacgtgctgcccagcgcgatacacacagcgcagcgcgataaataaaatacccggtgttgccttttgcgcatcggcactctcatccctgtcactcttctcaaggcgtttgtttatgttcggggccagtaccgccaaaatcgttgatgatagaccagacaatcgggccgctggcggcggcaggcagcgtgtactgcgcgttgccgaaaggcgccacatagcgcggggctttcactttttgactgccaacggaaagggtggcgaagttcatataatagggcgtggggttcttcacggtgagcgtgcgaccctgacgcgaccacgttaaccgatcggcaacctcttctggtttttgggttaacgcttttggccggtaaatcagcttaaattccgctttaacggccagcatgagtgtgttgtgtttattgtccggattgctgctgggaatcgatttaatatccagccagtacagcgactcgcgatcttccggcaaattgccgccggtacggataattcgtagtacgttcttttgcccgccattaaggcgaaaaagcggcggggtgaccataaacggcgcatcaccgctcgccccggtttcactgatcgattgcgcccaggactgaattaaatagggaacgttgtcgctattgcttatcgatatggacgcatctttggcatcgccgtgaaaaataacccgcgttgtgccgatgtttatccctgcggcatgcgccagcgaaccgcacaacaggcaacaaagcaaccctgctttagccaatgaattcattgatgacctcaataaacaaaggggccagccgacgctggccaccaggatcagttatattgcagatagaatgttgcggttgcatcgaccgttcccgacttaacgggaaccgcggtggcgatatagcgggcggtgaaaggcattgagagttccgtcaccccctctgctgtagggaggttgactggggcagaccatgcctgaagatcgttaaaggtcataggggtgctagttttatcaagaatttgcacgccaatattctcagcatcatcctcatttttcaggatggtcgcatcggttccgtcgagtgtgccttcaaagcgcgcctgtacactgctgtagacgtttgcgtcgcagttttcgagttcgatggtgaagtctgtatcccctgccgtctgccctgcggcagtgaaaagagaggcaaattcttcctgtaatgtcacctctactgaatccgtttttaccgtacaggcgttttgcttaatgaggccggtgatatgtacggtgccgtctttggcggtgtctgccagcgcggcgggggagagggtgatggcggccagtgccacagtgagtgtttttaaggagagtttcattatctttgatcctttaagatattataaatattgacatagtaacaatatctatagtgtggaaagttattgttctttttattcccgaatgagtaaatataatgtccgatgatttttacggcgcgaagaaaaattcagaatacataaatatgaaatatttataatatatatttaatcaattattttggtgagtgtttgtttaattgaatcgccgtgattaccctttaatgggccagattctatgaaggctgctaacaattttaaaaataatgcaaattttttttgaataaaaaatgatcgtggtcatagtgtgttgtcggccaaaaaaacatgctgacatcatgcaggattggagctcaatggaggagaagttatgctgggatgggtcatttcctgtcatgacgatcgggcgcaggaaatgctcgaaggtcttgaaaagaagtatgggccgttggcgcagtgtcgggcggtcaatttctggcgtgggttaagcgtaaatatgctcagccgcatgatgtgtgacgccctccatgccaccgactccggtgaaggcgtgatatttttaaccgacatttccggcgcggcgccttatcgtgtagcgtcgctgatgagccataaacattctcaatgtgaagttatttccggtgtcagctattcattgatggaggaaatgattacctggcgagagtcaatgagcagttcagcatttcgcgaccagattgtcgcgcttggcgcgccggatgtcaccagtctctggcatcagcagcagaaaaatccgccttttgtattgctgcatgattcgtatgagttttgatcaataccattgacgacgcttttgctacaatgacggcgttttttcgcctcggttatgatatatggttatgcgcgttgttcttatcttgctgttctttttcgccggtaatgtgttggctgccttgcccgctcgttatatgcaaacgacgaaagatgccgccatctggtcgcagattggcgacaaaatggtgaccgtagggaatatccgcgccggacaaattctttccgtaacgcctgttgcggctgattattatgcctttaaattcggcttcggtgtgggctttatcgataaaggccatctggaatccgtgcagggaaaacaaaaagtggaagatggcctgggcgatcttaacaagccgctcagcaatcagaatctggtgacctggaaggacacgccggtgtataacgcgccggacatcagtagcgccccgtttggcgtattggtggataatttgcgttaccccattattagcaagctgaaaggccggctacatcaaacctggtatcagatccgtattggcgacaggctggcttatgtcaacgccatggatgcgcaggaagacaacggcattccgattttgacctatcatcacattttacgtgatgaagagaatacccgttttcgccatacctccaccacgacttcggttcgggcattcagcaaccaaatgacctggcttcgcgatcgcggctatgccacgttgacgatgtaccaactggaggattacatctataaccgcgctaatttcccggcgcgcgcggtggctatcacctttgatgatggccttaaatcggtgagtcgctatgcgtatccggtattaaagcagtacgatatgaaagcgacggcatttattatctcatcgcgtattaagcgccatccgcaaaaatggaatcccaggtcgctgcaatttatgagcgtgtccgaattgcgcaagataagcgatgtttttgattttcagtcgcatacccattttttacaccgggtagacgggcatcgccgcccgattttatatagccgcagctaccataatattctgtttgattttgaacgctcgcggcgggcgctcgcacagtttactccgcacgtattttatctttcttatccctttggcggttataacgcgaccgcgatcaaagcagcaaaagacgccggtttccatctggcggtaaccacggtgagagggaaggtgaagccgggagataatccgatgctgctcaaaaggctgtatattctgcgcacggattcgctggaaaccatgtcgcggctgatcagcaaccagccgcagggataaggactatcaggcaacctgtaccggaatagctttcgcggtgcgcttcatttcgttgtcgccttcaaaataggccactttcggacgccatgtacgcgcttcttcatcagacatggtgacgaagctggcgataatcacaatgtcgccaacttcagcgcagtgcgccgccgcaccgttcaccgagatgattctggagccgcgttcagccgcaatcgcataggttgagaaacgtttcccattggtcacgttccagatatcaatcgcttcgttttccagaataccggaggcatcaaggaaatcctggtcaatggcacaggaaccttcgtagtgcaggtccgcctgcgtgacttttacgcggtggagcttgccttgcagcatggtgcgaatcataacttctttaccctgtcgtttaccttggctaagcaggcgcttgtggcctgctttggaaattctcaggcagtattgcccgatttttaacccctgtctactgggctaatgtaacgctttgattatcgatcagacgcgcctgacccagccaggcggcagccagaatcactgcgcgtttgctggtttccgtcagctccagcagcgtgtcggcatcacggatttgaatgtcgtcggcacggaagcctttttcattcagttcctgttcggcaatggcaataatctcttgcagctcacgattacccgcaatcagtttttcagcgatgctattcatcacgttgtatagacccggcgcaattttgcgctgctctgcggtcagataagcgttacgtgagctgagcgccagaccgtctttagcgcgaataatcggcacgccgacgatctcaatgtcataactcatatccgccaccattttgcggatcagcgccagttgctggaaatccttctcgccaaagcaggcgatatccggctggatcaggttgaacagcttgctgacgatagtcgagacgccgcggaaatgacctggacggctggcgccttccagcatggtagagaggccgggaacatcaacgtacgtctggccttccagcccatgcgggtagatttcctcaacggctggcgcaaagacataatcgactttgcgtttgttcagcttttcacaatcttcctgcagcgtgcgcggataacgcaccagatcgtccggccgatcaaactgcatcggattgacgaaaatgctgacgatcaccacatcagcccgggcttttgcctcatcgaccagcttcatatggccgtcgtgcaggttgcccatggtgggaaccagtgcgacgcgtttaccttcctgacgcagacgacgaatatgctggcgcagcagcggcagggtttcaatgattagcacaacaaaactccttgagttgcttgatgatcctgcccgatggcgctgcgcttatcaggcctacatccgttgaggatctgtaggccggataagacgcgtcgcgtcgccatccggcacggtcagaaaaattagtgaaagctgtgttcttcgcccggataaacgccggactccacttcagccatatactgctgtacggcggcgcgcatgtcgcccgcttcggcgaggaaatttttcgcgaattttggaatatgaccgccggtgatgccaaacgcatcgtgcatcaccaggatctgaccgtcggtgacgttgcccgcgccgatgccgatcaccggaatcgacagcgcttccgtgacgcgcttcgccagctcaaccggcacgcactccagcaccagcagttgagcgccagcggcttctaaagccagcgcgtcatccagcagcacttgtcctgcatctccacggccctgaattttatagccgccgaagatattcaccgactggggcgttaaccccagatgaccacaaaccggcacggcgcgttcggtgagcattttcaccgtatcaaccagccaggcgccgccttcaattttgaccatattggcccccgcacgcatcacgatagccgcgttttcacatgcctgttccggggtggcgtaagccataaacggcaggtcggagagcaatagacagttgggcgcgccgcggcgtaccgcgcgggtgtggtaggcgatatcttccacggtgacaggcagggtggagtcgtgcccctgaattgtcatgcccagagagtcgccaaccagcatcacattgataccttcgtcggcaaataacttagcgaagctgtagtcgtaggcggtaattgtcgcgaagcgttttttctcttgcttgcatttctgcagcagtgaaatggtggtgggtttcataacgtttcctgatggtaaaagttatatttcccggcattctaacagtcatattcaggggggcaattgatttaagcaatcgtttggcgctaaagcagtaaacgctaaaggggaggcgatgttttaccagtgggcgggttttgcagcaccaagatgggtgagatgctgatgcaggctgataccatccggaaagatcagatcaggagcgatttcgaataacggccacagcataaaaccgcggtttttcatgtcgtagtgcggcacggtcagacggtcggtgttaatgacttcatcgccaaacagcataatgtcgagatccagcgtgcgcggcccccagcgttcggctttgcgcacccggccctgttgcagctcaatgcgctgggtatggttaagcaattcttcgggggcgagagcggtatccagcgccaccgcagcgttcaggtaatcgggctgatcctgtgggccaagcggcggcgtgcggtaaaacgaagaaaccgcgacgatacggctatcgggaatgtcggcgatagccttcagggcggcattgacctgctccagcggagaggccagattactgccaagcgcgatatacgcgatcgtcatacggtgccctcgcggcgcggcgcgcgtttgcgcggacgtgaacgacggcggcgtggagcaggatcgtcgtccagctcgttgagcatccctttttgttccggcggcgcggaagcctgaaactcggcccaccactgcgccagacgttgcagttcagtattattttccacctgagcgcgcagctccagtaaatcaaacgcggcgcggaatttgggatgttccatcagtttccaggcgcgtttgccctgacgtcgcgacatgcgtaactgaagctgccaaatatcacgggtaagcgtggtaaggcgtttcgggatcgccagtgaacggcaggcctcatccagcacatcattcatggccagcgcgaaagcgtcgtaataggccagaccgctctcctgagcgattttttgcgccatctccagcagcggataccagaacatggcggcaaacaaaaatgccggattaacgcgcatctcgttacggatgcggttatccgtattcttcaacacctgcgcaatgatgcgttccattgcgctgtcgccgttttcggtgaaataacgcgtaatggtaggaaacaacggctggaagaggtggtattcccgcagttgttgataggtttcgtaaccgttccccgcctgcaacagcttcagcgactcttcgaacaggcgcgcgggaggaatgtcgtttagcaaggttgccagacgcgggattggctcagccgtttcagggctgatatgcatattgagcttcgcagcgaaacgcacggcgcgcagcattcgaaccggatcttcgcggtagcgcgtttccggattgccgatcaggcgaatcacgccttcttgcagatcctgcatcccgccgacgtaatcgcgcacggtaaaatccgccacgctgtagtaaaggctgttgatggtgaaatcgcggcgctgggcatcttcttcgatagagccgaagatgttgtcgcgcagcagcataccgttttgcccacgctgggaggtcgtacggtcgctttcactgccttcatgatgaccacgaaacgttgccacttcgataatttccgggccaaacatcacgtgagccaggcggaaacgacgtcccaccagacggcaattgcggaataatttccgtacctgatccggtgttgcgttggtagtcacgtcgaaatccttcggctttttgccgagcaggagatcgcggacgccgccgccgaccaggtaggcttcatagcccgctttgttcagcctgtacagtaccttgagggcattttcactgatatctttgcgggagatagcgtgctgttcacgcgggataatcgtcatatgtggacgggcgacggcttgttctgcctcgctctcctcgcggcttaacaccttacggcaaaaattagcgactcgggtaaaaatagcgcacctcggtagtgtcatacattaataagatcaacttactctatgtctttcgcattacggcagacgggcgtaagagagcaacgcgacctgggctgtaagcatcattaacgccgcagcaatgcgaaagacgatgagcaaaaatagcggctaatcatagctcagcgagacgcatttgagaatgccggatttacattagccgatgtgggtacggctgtaagcctccagtgcgccactgcaaagcgcagcaactcctcaacagacatctcctgccacgctacgacgtcgcgttggcctaaaaagcgcaatgcctggaccagtaccgggcgcggatcgcctgtcgcaagcgcaggggcatgattttgcttggaaagtttagcgccttgttcgttgagcgccagcggaaggtgcacgtagcctggcgcacgccagccaaactgtttatacagcgaaagttgtcggacagtgggttcgattaaatctgcgccgcggacgatctccgtcaccccctgaaaatgatcgtcgaccaccacggccagattataagcaaacagtccgtcgcggcggtggataataaaatcttcgctcgccagctgtgggtcagcctggatgtcgccgcgcaaggcatcatggaaatgcatcaccggatgctgctgtttaattctgacggcggcattctccggcccgtggcataacgtccgacaatggccgtcgtaaataccgcccagacgttgaatgcgcgagcgggggcaagtgcagtagtagctcagtccctgctcgtgaagccaggccagcgcctcgcgataagcctcatgacgctgtgattgccataagacctcgccatcccagtgcaggccgtaatgttccagctggcgcagaatggtcgctgcggcaccgggaacttcacgtggggggtcgatatcctcgatgcgaacgcgccaaattccgcgttgcgcacgggcttgtagatagctgccgagggcggcgattaacgagccgaaatgcagttcgccggatggcgacggcgcgaaacggccaatatagtgtgagtcagtcatgctgcgggcaataaagaataaggcgggaaaactcccgcctgtcataaatagggtagaaacgaacgggattaacccgccatctgtttttcgcgaatttcagccagcgttttgcagtcgatgcacagatcggctgttggacgcgcttccaggcggcggataccaatctccaccccgcaggactcgcaataaccgaagtcttcatcttccactttcttcagcgtcttctcgatctttttgatcagtttgcgctcacggtcacgattacgtaactccaggctaaactcctcttcctgcgcggcgcgatcgaccggatcggggaagttggcggcttcgtcctgcatgtgcgtcacagtgcgatcgacttcatcccggagttgattacgccatgcttcaagaatacgcttgaagtgcgatagctgggcttcgttcatatactcttcgcccggtttctcctggtacggctccaccccagcgatggcgagaatactcagggacgatgttttacggttttgcccttcttgcatgttgcttctccttaacacgcactatcgatccccatgttcgggggaaaatcaggtcgctataaatagcagatgcttttccggatagcaattatctaaacgtaacacttgacaaccctgtgaggaaaagcgtatttacgcacgcggccagaatacttaataatcaggctgttattccactacaacgttatgggtactggttcgttcagttccattttttgggctgaaagttctgctttataagctaaaacttccacgcctttattctgagcctcgctcaatagctgcgcgtattttatatcgatatgacgtgcgggggaaaaacgtgtaatggcggagtgcagcaccgcgaacaccaccactgcgcgatgacctgccgccgcaacgcccatcaattcccgaagatgtttttgccctcgttcggtgatggcgtcgggaaaataaccgttttctttttccgctaacgtgaccgatttcacttcaatatagcagtccgggcggaaatctgcctgtaacataaaatctatacggctgcgctcggcgccatatttgacttcacttttcagaatattgtaccccgccagcgccggcaggcgattctcctgaatcgcttctttcgttagctggttcgcccgcagcgtattcacgcaaatgaatgcgccggattgcgtttcagtcaattcccaggtatgcggatatttgcgtttagtattttctgatgtcgaataccagacggtatcgccaggcgtggcgcagccggtcatcgcgccggtattaggacagtgcagcgtaagcgtcgtaccgtcaggggtgatcacatcggctaaaaaacgtttatagcgctgaatcagcgtagcgcgttgtaaagggggtgaaaatagcatcgacattccttcattattattcgcccagcgtccagcgctgcagctcggcatagcgggtacggccttgcccatacgaagaggcgtaaagcgcaaacgacgtgaccggaaatgaccagcaaaagcccggcggcgggatagccaccgtatggctggcgtcgcgcagcagcgtaatatgcgggtgaaaaggctgcgggctttggtaacaaccgctgcgggcggcctgcgcgcgcagcatattagccaactgcaacaacccgcgcggcggctggcgcatccccagccacaccacgcgcgaacgcagccactgaccggcgtcatccagatgtagcgtaaagcccggctgtcgaattcgtccggccagttgcgcaagcgcgcgctgcttatcgctactgacgtcgcctaaaaaggccagcgtcaggtgcaggttcgccgctgccacggggcgtccgtcttcagacgcaaaatgggcggcgcgccaggcgataatttgcgcgcgcgcgtcgtcgggtaagtcaatcgcaaaaaacagccgttttggctcagacatagggatactcggttatggattaacacgatgctacaatgcggcgcaaagaaagttaaccccgtggagccgtttgtgacgtcattgcccgttgccgccgtattgcctgaattgttgacagccctaaaaatcgcgccgcaggttttgttgtccgcgcctaccggggcggggaaatccacctggctgccgttgcaactcctgcaacaggggccggttgctggaaaaatcctcctgcttgaaccgcgtcgtctggcggcgcgtaatgtcgcacagcgtctggcggaagcgttgaatgaaaagcctggcgaaacggtaggttaccggatgcgcgcgcaaagctgcgtggggccgcgtacccggctggaagtggtgaccgaaggcgtattgaccagaatgattcagcgcgatcccgaattacgcggcgtggggctggtgatactggatgaatttcatgagcgcagtttacaggcggatttagcgttggcgctgttgctggatatccagcaagggctccgtgacgatctcaggctgttaatcatgtctgcgacgctggataacgacaggctttgtcagcgactgcctgatgcgccgacgatcgtctcggaggggcgcgcgttcccggtggagcgacgttatcagccgcttgcggcgcatttgcgttttgatgaagccgtcgcgatggcgacagcggaactgctgcgcaatgaaaacggttcgctgctgctatttttacccggcgtaggcgaaatacagcgcgttcatgaacatctggcgtcgcgggtagggagcgatgtcctgctttgtccgctgtatggcgcattgtctctggaagcgcaacgcaaagcgattgttccggcacccgccgggatgcgtaaagtggtgttggcgactaacattgccgaaaccagtttgacgattgaagggattcgtctggtcgtcgatagcgctcaggagcgcgtggcgcgatttgacgcgcgaacgggactgacgcggctggttacgcagcgtatcagtcaggcatcaatgacgcagcgcgcggggcgcgccggacgactggcgccgggtatctgtttacatctgctggccaaagaacaggcggagcgggcggcggcgcaaagcgatccggaaatcttacacagcgacctttccggtttattgatggaggtgttgcagtggggatgtcacgatccggcatcgcttttctggctggacaggccgccggaggtgaatcttcaggccgcccgccgtttattattgatgttaggcgcgctggagggcgagcggttaagcgcgcggggccggaaaatggcggcaatgggtaacgatccgcgcctggcggcgatgttagtcaacgccggcgagggcgatagcgccgccactgccgccatgctcgcggccatccttgaggacccgccgcgcggcggcggtacggatttaagcgtagtattttcgcggcgacagccgggctggcagcagcgtagccagcagcttttaaaacggctgcaggtgcgtaatggcgagccggatagcgcgcttattatgccgctgttggccagagcgtttagcgaccgcatcgcgcggcgtcgtggtcaggaagggcgctatcagttagccaatggtatgggcgcgatgttagatgcggatgacgcgttgggacgtcatgaatggctgatcgcgccgctgttactgcaaggtagcgcctcgccggacgcccgaatattgttggcgcagccgctggatattgcctcgctgattcaggcgtgtcctgatttactgcgccagtccgacacggttgaatgggacgaggcgcagggaacgttgaaagcatggcgcagaatgcgtattggacagttgacggttagcgttcagccactggcgaagccgtctgaagaggagcttcatcaggcgatgctgaacggcatccgcgataaaggtctgtccgtccttaactggacgccggaagcggagcagttccgtctgcgtctgcactgtgcggcgaaatggctgccggaatatgactggcctgccgtggatgaggcgtcgctgctggcgactctggaaaattggttgctgccgcacatgacaggcgtacagtcgttacgagggctaaaatccctgaacgttaatcaggcgttacggggactgcttgactatgccatgctgcaacgtctggatagtgaactgcctgggcattacactgtgccgacgggaagccgaataacgattcgttatcatgaagataacccgcccgcgctggcggtcagaatgcaggaaatgtttggcgaagcgaagaccccaaccatcgctcagggccgcgtgccgctggtgctggaactgctttcgccagcgcagcgaccgctacagattacgcgcgatttaagcgctttctggcagggggcgtatcgcgaagtgcaaaaagagatgaagggccgttaccccaaacatgtctggccggacgatccggcgaatacggccccaacgcggcgcacgaagaagtattcgtgacgtgttatacgttgcctccaggccagataaggcgttaatcgccatccggcaaaagagtaaattgagagatttcttcttctgtcgtctggcggaagaatagagaatcgggcctttgcgcctgtatgttgcggagaaaaagcatggcggggaatgaccgcgagccgattggacgtaaggggaaaccgtcacgtcctgtgaaacaaaaggtgagccgtcgtcggcagcatgacgacgattatgatgatgactatgaggatgaagaaccgatgccgcgtaaaggtaagggcaaagggcgtaagcctcgtggcaagcgcggctggctgtggctattgctaaaactgtttatcgtttttgtggtgctgttcgccatttacggcgtctatctggatcaaaaaatccgcagccgtatcgatggcaaggtctggcagcttccggcggcggtatatggccggatggtgaaccttgagccagacatgcctgtcagcaaaaacgagatggtgaaattgctggaagcgacgcagtatcgtctggtgacgaagatgacccgtcccggcgaatttaccgtgcaggccaatagcattgagatgatccgtcgtccgtttgacttcccggacagcaaagaagggcaggtgcgcgcgcggctgacgttcagtgacgggcgtctggaaaccatcgtcaatctggataacaaccgccagtttggcttcttccgtctcgatccgcggcttatcaccatgctttcttcgccaaatggcgagcagcgtttattcgtcccgcgcagcggtttcccggatctgctggtcgatacgctgttggcgacggaagaccgtcatttctatgagcatgatggcattagtctttactctatcgggcgtgcggtgctggccaacctgacggcgggacgcacggtgcagggggccagtacgctgacccagcagctggtgaagaacctgttcctctccagcgaaagatcatactggcgtaaagcgaatgaagcctacatggcgctgatcatggatgcccgttacagtaaagatcgtattcttgagctgtacatgaacgaggtctacctcggtcaaagcggggacaatgaaattcgcggttttccgctggcgagcctgtattactttggtcgtccggtagaggaactgagcctcgatcagcaggcgttactggtggggatggtaaaaggggcgtcgatttataacccgtggcgtaacccgaaactggcgttggagcgtcgtaacctggtgttacgcctgttacagcagcagaaaatcatcgatcaggaactctatgacatgctgagcgcgcgtccgcttggcgtacagccgcgcggcggcgttatttcaccgcagccagcgtttatgcagatggttcgtcaggaactgcaggcgaagctgggggataaaattaaagatctctccggcgtgaagatcttcaccacctttgactccgtggcgcaggatgccgcagaaaaagccgttgtcgaaggtattccggcgttgaagaagcagcgtaaattgagcgatctggaaaccgcgatggtggtggtggatcgctttagcggcgaggtgcgcgcgatggttggcggggcggagccgcagtatgccggctataaccgtgccatgcaggcgcgccgttccatcgggtcgctggcgaaaccggcgacctatctgaccgcgttaagtcagccgaacttataccgtctgaacacctggattgccgatgcgccgatttctctgcgccagccgaatggtcaggtctggtcgccgcagaacgacgatcgtcgctacagcgaaagcgggaaagtgatgctggtggatgcgttaactcgctcaatgaacgtaccgacggtcaatctggggatggcgttaggtttaccggcggtaaccgatacctggacgaagctcggcgtgccgaaagatcagctcaatccggttccggctatgctgttaggagcgctgaacctgacgccgatcgaagtggcgcaggcgttccagactatcgccagcggcggaaatcgcgcgccgttatcagcgctgcgttcagttattgcggaagatggtaaagtgctgtaccaaagttatccgcaagctgaacgcgccgtaccggcacaggcggcttacctgacgctctggacaatgcagcaggtcgtccagcgtggtacggggcgtcagcttggcgcgaaatatccgggtctgcatctggccggtaaaaccgggacgacaaacaacaatgtcgatacctggtttgccggtatcgacggcagccaggtgactatcacctgggtaggccgtgataacaaccagccgacgaaattgtacggcgccagcggcgcgatggcgatttaccagcgctatctggcgaaccagacgccgacgcctttagttctgacgccgccggaagatgtggtggatatgggcgttgattacgacggtaattttgtctgtagcggcggtatgcgcactctgccggtctggacggacgatccaaatacgctgtgccagcagggcgagatgatgcagcaacagcagcagccgtcaggcaatccgttcgatcagtcgtctcagccgcagcagcctgcgcagcaacagccgccgaaagaagagaagagcgacggcgttgccggctggattaaggagatgttcggcggcaattaatcacggtaatagtgccgggtggcgctgtgcttacccggtctacaccgttacgaccccattatgtgcgacgtaggccgaataagacgcttacgtcgccatccggcaaatcctccataaataacatttcagtctaatttattaacccttccttttcatctggttatttcttaaccccttagttttcgtagggccgcgtatcgcttgccattgcgacgatatttcgcctatcatgctgcggttataataataattatcgtttacgttatcattcactttcatcagagatataccaatggcgcgtcttaaaactgctcagccaaactcctcactgcgtaaaatcgcagttgtagtagccacagcggttagcggcatgtctgtctatgcacaggcggcggttcaaccgaaagaagaaaccattaccgtaaccgcagcgcctgccgcgcaggaaagtgcctggggaccggctccgaccatcgccgcgaagcgttccgccaccaccaccaaaactgatacacctatcgaaaaaacgccacagtcggtttcggtggtcactaacgaagagatgcagatgcatcaattccagtcagtaaaagaagcgttgggttacacgccgggtgtaacggtaagcagccgcggcgcttccaatacctatgacttcgtgattatccgtggcttctcttccgtcggcctgagccagaacaactatctggatggcctgaaattgcaggggaacttctacaacgatgcggttattgatccctacatgcttgagcgtgttgagttgatgcgtggcccaacgtccgtcctctacggtaagagcaacccgggcggtatcatttcgatggttagcaagcggccgactactgagccgctgaaagaaattcaattcaaaatggggacggacaatttgttccagaccggttttgattttagtgattccctggatgacaacggtgagttctcatatcgtctgacggggctggcgcgttcgacaaatgagcagcaaaagagttctgagtcgcagcgctatgcgattgcgccctcttttacctggcgtcctgatgagaaaacgaattttacgttcctttcttatttccagaacgaaccagagaccggctactacggctggctgccgaaagagggaacggttgaaccgttaccgaatggtaaacgcttgccgacagatttcaatgaaggggcgtcaaacaacacctattctcgtaacgagaaaatggtgggatacagtttcgagcatggcttcaacgacacttttaccgtgcgccagaatttacgttttgtcgaaatgaaaaccgcgcaaaaaagcgtctatggcacggggattgcggcggacggccatacgcttaaccgcggtactatcgttgacaacgagcgtttacagaatttcagcgtagatacacaactggaaagtaaattcgcgaccggcgatattgatcatacgttgctgacgggtgtcgatttcatgcgtatgcgtaatgatattaacgcgacgtttggtagcgcgccgtcaatcgatctctataacaattaccatcctgaatactttgctttcggcggcgctgagccgtaccagatgaacgaaagtaaacaaacaggcctctatgttcaggatcaggcggaatggaataagtgggtatttactctcggcggccgctatgactggtctaaacaagcgacaacggtgcgtcagaattccactacgccgacagaaggatatattgaacgtaatgaccaccagttcacctggcgcggtggcgtaaactacgtattcgataatggaatttcaccttacttcagctatagccaatctttcgagccaagcgccttcgatttgtggagcaccccacgcgtttcttacaagccgtcaaaaggcgagcaatatgaagcaggggtgaaatatgtaccgaaagacatgccggttgttgttacgggtgccgtttatcagctgaccaaaaccaataacctgaccgccgatccaaccaacccattagcgcaggtgccggcaggcgaaattcgtgcgcgaggtgtagagctggaagccaaagcagcattgacggctaacatcaatatgacggcgtcttacacttatactgatgctgaatacacgaaagacactaatctgaaagggaatacgccagagcaggtgcctgaacacatggcgtcgttgtggggcgattacaccttcaacgaaggtccgttgtcaggtttaacgctgggaacaggcggtcgttttattggttccagttacggcgatccggctaatagcttcaaggtaggcagcgcagcggtgatggatgcggtcgtcaagtacgatctggcgcgttttggtatggcgggctccagcattgcggttaacgttaataatctgctcgaccgcgaatacgtcgccagctgcttccagacctacggctgtttctggggcgcagaacgtcaggtcgttgcaacggcaaccttccgtttctaatttctttttgggcacggcttgccgtgcccgttttacaagttggctgcgatgcaggaaaaccacattcattccgataccacctttgcgctgcgaagcgtcgcctttcgtgtgccgggccgcacgcttttacaccccctctcgttaacgtttcccgcaggtcgcgtcaccggacttattggtcataatggttccggtaaatccacgctgttaaaaatgctgggccgccatcagccgccttccgaaggggatattctgctcgacaatcagccgctggcgagctggagcagcaaggcgtttgcccgcaaagttgcctatctgcctcaacaattgccacaggcggaaggaatgacggtgcgcgaactggtggcgattggccgctatccgtggcacggcgcgctgggacgctttggcgtcgcggaccgggaaaaagtagacgaggcgattacgctggtcggcttaaaaccgctggcgcatcgtctggtagacagtctttccggcggtgaacgccagcgcgcgtggattgccatgctggtcgcgcaggacagccgttgtctgctgctggatgagccgacgtcagcgctggatatcgcccatcaggttgacgtgctggcgctggtgcatcgtttaagccaacagcgcgggctgacggtggtagcggtgctgcacgatatcaacatggcggcccgctactgtgattatttagtcgcgctacgcggcggtgaaatgattgcgcaaggaacgcctgcggaactgatgcgcagtgacacgctggaacagatttacggtatcccgatgggtatccttccgcatccggcgggcgcggcacctgtgagttttgtgtattaatgcgtgatttatatcctcttactcgccgccgtttattaacggcgatggcgctctcgccgctgctgtggcaaatgaatacggcgcaggctgccgctatcgatccccgccggattgtggcgctggagtggctgccggttgagctgctgctggcgctcggtattacgccgtatggcgtggcggacgtgccaaattataagctgtgggttagcgaaccgccgttgccggattcggtgattgatgtgggtcttcgcactgaacccaatctcgaactgctgacggagatgaagccgtcgtttatggtctggtcggcaggctacggaccctcgccggagaaactggcgcggatcgcgccggggcgcgggttcgattttagcgacggcaaaaagccgctggcggtggcccgacgctcgctggttgaactggcgcagacgctgaatctggaagctgcggcagaaaaacatctggcgcaatacgatcgcttcatcgccagccagaagccgcattttatccgccgcggggggcgtccgttactgatgacgacgcttatcgatccgcggcatatgctggtgctcggcccgaattgcctgttccaggaggtgctggacgagtatggcatcgtcaatgcctggcagggtgaaaccaacttttggggcagtacggcggttagcatcgatcggctggcgatgtataaagaagcggatgtgatctgcttcgatcacgggaataacaccgatatgaacgcgctgatggcaacgccgctgtggcaggccatgccgtttgtccgcgccgggcgctttcaccgggtgcccgccgtttggttctatggcgcgaccctctccacgatgcactttgtccgcatcctgaataacgtgttgggaggcaaagcgtgagcagaaaacgtgaaatgccggatggcggcgcgaaaagcgtcttatccgacctacggttcgggcgctttgtaggccggataaggcgaagccgccatccggcgttgctgttattggcgctgtttgttgccgcctgctggctgacatgggttaacttctccgttgcgctaccgcgcagccagtggcaacaggctatctggtcaccggatatcgacatcattgagcagatgatttttcattacagccagctgccaagactggcgatttcgctgctggtgggcgcggggcttgggctggtaggcgtcctgttccagcaagtattacgtaacccgctggcggaaccgaccacgctgggcgtggcgaccggcgcgcaattggggatcacggtgactacgctttgggcgattcccggcgcgctgaccacgcagtttgccgccctgacgggagcctgtatcgtcggcgcgctggtgttcggcgtggcgtggggcaaacgtctgtcgccagtgaccctgatcctcgccgggctggtggttagcctctattgtggcgcaatcaaccagttactggtgattttccaccacgatcagttgcaaagcatgtttttatggagcaccggaacgctaacgcaaaccgactggagcggcgtgcagcgtctgtggccgcagttgctgggcggtgtgatgctcacgttattgttgttacgcccgatgacgctgatggggctggatgacggcgttgcgcgtaatctgggtctggcgctgtcgttagcgcgtctggcggcgctgtcgctggcgattgtgttgagcgctctgctggtcaacgcggtgggcattatcggttttatcggcctgtttgcgccgctgctggcgaaaatgcttggcgcaagacgtctgctggcgcgcctgatgctggcgccgctcattggggcgcttattttgtggctatccgatcagattatcctttggctaacccgcgtatggatggaggtttccaccgggtcagtgacggcgttaatcggcgcgccgctgctcctgtggctgctgccgcggcttaaaagcatgagcgcgccggatatgaacgccagcgatcgtgtggcagcggaacgtcggcacgttcttgcttttgccgttgccggtggcgcgctcctgctgctggcaacatgggtcgccctctcttttggtcgcgacgcgcacggctggacgtgggcgagcggaacgctgcttgaagaactgatgccgtggcgctggccgcggatactggcggcgttaatggcgggcgtcatgctggcggtggcgggctgcattattcagcgtctgaccggtaatccaatggccagcccggaagtgctggggatcagttccggagccgcgtttggcgtggtgttgatgctgtttttggtgccggggaatgccttcggttggctactgcctgccggaagcctgggcgcggcggcgacactgctgattattatgatagccgccgggcgcggcggtttctcgccgcaacggatgttgctggcggggatggcgctcagcaccgcgtttaccatgctgctaatgatgctccaggcgagcggcgacccgcggatggcggaagtattgacctggctctcaggatctacctataacgccactggcgggcaggttacgcgaaccgcgatcgtgatggtgattttgctggccattgtgccgttgtgtcgccgctggttaacgattttgcccctgggcggcgatgccgcgcgtgcggtgggcatggcgcttacgccgtcgcgtatcgcgctgctggcgctggcggcttgtttgacggcaaccgcgacgatgaccattgggccgctgagtttcgttggactgatggcgccgcatattgcgcggatgctcggttttcgccggacgatgccgcatatggtcatctcggcgctggcagggggcgttttactggtctttgccgactggtgcggcaggatggcgctatttccgtatcagatcccggcgggactgctttcaagctttattggcgcgccgtactttatctatttgctacgtaaacagagtcggtaaaaaaaagctgtgccacatttatgtcgggtggcagccatgctcaacccgacctacaaattacacaatatcaatatgttgtggcaatattttgtaggcctaaaaatagctgaacgctatcaggtgcgagagctgtcctgtcacgttttatcgagggaactctgcttttattttcagcaagaagcaggtgttatttttgtatcgataagtcatgagctatttcagtggcgcgccgctgtctcgtgaacagggtgactcatttcaacatatccaggcccgaaacgttgatgataaattgcggcatgatctatccaataataagaattaccggtttcggtattaagcctttttaaatattaagatgcggatgccgcatctttaatgcatctcgtaaatcaattttaatttaataataaattttcattataaaacttcgataataaaatattatttttttatcgaagtaataaaaaacaactctattaaaataaattaattgccacgagtaaacaaaaaaaatgtaatttagcattttttgttttttttaatgaaatttataccaaaaataaatgttacgcgtcattgctatatattcagtactgtaattctgatctttttttattcattttgacatgtttattgtttttttggctctcccgtcttgcttgctttgtttgttttttgaacggtaaaaatatttattatttaattctgataatcctttaaataaaaaacgcttgtctttgggtttttaatggaaaatacttcaccgcgcctaagggatgttatttattaacgtgttgtttgcttcttttgaatgttgcatcggcaatttcataactcgtcatataatatatatctactaatataaacatggggtattgagtataactctgtgtgaatagcgtaaaaatactcaccaacttttaataaggatgaaaaatgaatacagcagtaaaagctgcggttgctgccgcactggttatgggtgtttccagctttgccaatgctgcgggcagtaatactggtacggtgacttttaccggtactattgaagattcaccgtgttcaatcgtggttggcgacgaacaccagaccgttaacctgggccatatcggtaccggttctctgatgggcggtaaagaatcttcaaaagtcgatttccatatcggtctggaaaactgcgcattcaccactgagaaagaagcgtctaccgttttctctgccatcggtaacgaatccagcgctaatccgggcagcgttgcgctgatgcgtatcggcggcggcgaaatggcgggttccagcattgttatcggcaaccacctgggttccgcgatcaaattgggcgacgcttacagcgaaaacctgacgatgaacggcagcgttgcggcggcgaaacagactcttaacttcaaagcctgggtgaaaggcgattctgctgccaccactatcgataccggcgaattcagcagcaccgtaaacttcacgatcagctatctgtaagtgaaatatcatcctgcggcagtctgccgcaggatgatgctcaaagtaaaaaaatagattatatatttcagggatagattgtctgatggctcactataaaaaatttcgtctgagcacgcttgcggccgtggtgggtattgttctggctgtcggtccggaaaatagctacgcggaagcgcccattcaatttaatacccgatttcttgatgttaaagatgatgccagcctggatctctcccgtttttcccgtaaaggctacattatgccggggagctatcatctccaggtgctggtcaatcagagtcaaattgtccaggataatgttattacgtattccgttgataataacgatcctgataacacctatccctgtttatcgcctgaactggtctcgctgctggggttaaaacctgaaatagcagataaaatgatctggataaatgccggtcagtgtctgcaaccagatcaactggaagggatggaaacccaaacggatttaagccagtcaacgctgacggtgattattccgcaggcgtatctggaatacagcgatgaagagtgggatccaccttcccgctgggatgaagggattcccggcgtattatttgactacaacgttaacagccagtggcgacatgctgaacatgatgacggcgatgaatatgacatcagcggcaacggcacggtgggtgccaacctcggcgcgtggcgtttgcgcgcggactggcaggctaactatcgtcacgaaaatgacagcgaagataaagacaactttggctccagttccgaacagaactgggactggaaccgctattacgcctggcgggcgatcccgcagctccgggcgcagctaacgctgggcgaaggatcgctggaatccgatattttcgacggctttaactatgttggcggcagccttatcaccgacgatcagatgttaccgcctaatctgcgcggctacgccccggatatatcaggcgtggcgcgcaccaacgccaaagtcaccgtgacccagcgcgggcgggtgatttatgagtcgcaggtcccggctgggccgtttcgcattcaggatattaatgaaacggtatccggcgatctacacgtcaaaattgaagaacaaagcggtcaggtgcaggaatatgacgtcagcaccgcctccattccgtttctgacccgtcccggccaggtgcgctacaagttggcagccgggcgaccgcaggactgggatcacaatatggaaggcggctttttcacctcagccgaagcctcctgggggatcgctaacggctggtcgctgtacggcggtgccatcggtgagcaggattatcaggcgctggcgttaggactggggcgcgatctggcgctgctgggcgcgttttccgtcgatgtcacccattcccgtgcgacgctgccagagggtagcgcctacggcgacggcaccattcagggtaactcgttccgtgccagctacgctaaagattttgatgatatagacagccgtctgacgtttgctggttatcgcttttccgaagaaaactacatgacgatggacgagtttatcgatacgcataatgacgataacgatcgtcagcgcaccggccacgataaagagatgtataccctgacgtacagccagaacttttcggcaataaacgtcaacgcctatatcaactacacccatcgcacctactggaatcaacctaaccaggacagctataacctgacgctgtcgcactatttcgatgtcggtgaggtgcgcgggatcagtctgtcggtgaacggttttcgcaacgaatatgacaatgagcgtgatgacggcgtgtacgtctcgctcagtattccgtggggcaacaaccgcacgctgagctacaacggctcctttagcgatgacaacaacagcaatcaggtcggctattacgagcgcattgacgatcgcaataactaccagatcaacgctggtcgcgcggataacggtgcgactctcgacggctactaccgttatcaagcgagctatgccgacattgacgtcagtgcgaactatcaggaaggcgactatacctccggcggactgaacatccagggcggcgcgacgctgactgctaaaggcggggcgttgcaccgcaccagcgtcaacggcggctcgcggctgctggtggatgtcggcgatgaagcgaacgtacccatctccggctacagcacgccggtatataccaacgcgtttggtaaagccgtcattgtcgacgtcaacgactactaccgcaaccaggtgaaaatcgacattacccagttgccggaagacgcggaagcaatcctctccatcgctcaggcgaccctgacggaaggggcgatcggttatcgccgcatggaggtgctcagcggtaaaaaagccatggccagtatccgcctgcgcgatggcggcacgccgcccttcggcgcagaggtttacaacagtcgccagcaacagttagggatcgtaggtgaagacggcagcgtttatctgatcggcattaaccccggcgagcggttgcaggtgacatgggaaggtaaaacgcagtgtgaagcgacgttgcccgatccgctgccgggcgatctgtttagcggcctgttgctgccgtgcatcggcgacgcttcatcacctgaggcaacgcagcccgaagagaaaccattactccagcttcatacgcagcggcggacgtcttcgacgcaacccgaagcgctctcttctcgttatccaacacattgattcaggaaaccgcattcatgatgtcattaaaacgttataacctggccgctgttttgctgcttttgctgggcggctacggtagcgcccaggccgccatcgcgcccgatcgcacccgcctggtgtttcgcggcgaagataaatcgataagcgtcgatctgaaaaacgccaacagcaaactgccctatctggcgcagtcctgggtggaagatgagaagggcgtcaaaatcacctcgcctttaatcgtcgtcccaccggtccagcgcattgagccgtcggcaatcggacaggtcaaaattcaggggatgccggcgctggcgtcgctcccccaggatcgggaaacccttttttattacaacgtgcgcgaaattccgccgcaaagcgacaagcccaatacgctgcaaatcgccctgcaaacgcgcatcaaagttttttaccgcccgcaggcgctatcgaaaatcgatatgcagcatccctggcaatacaagatcacccttcagcgtcagggcaatggctatcaggtgagcaacacaaccggctactacgtggtgttaagcaacgccagcaaccgcatggacggcacaccagccagaggctttagccctttagtgattgcaccaaaaagcaacgtgacgctgggaggggacgccagtgaattaggtcactcgcctgtgctgacttacgtcaacgattatggcgcgcggttaccgctgatttttaactgtactgacaacagttgtgcggtagatgaagcaaaaagcagaaagtcgtaaccgacaaggagacgcaagatgaggcaatggcggttacggctgggcacggtaacgtgtgcggccatgctgagtgcggtcagtatgccgctggcagcgggaagtaagacggtcaacatgacgctgacgatagtcgttaatgccgcgccgccctgtactgtgaccggcggtgaggtggaatttggcaatgtgttgacgacgaaagtggatggggtgaattaccggcaggcggtgggctatcgcctgagctgtaacggcagagtgagcgattacctgaagttacagattcaggggaatgcggtgactatcaatggcgagtcggtattgcaaaccgatgtcgatggattgggtatccgtctgcaaaccgccacggatggcgcgctgatttcacccggcaatacgcaatggttgtcatttcaatacagcggcggcagcggtccggccattgaggcgattcccgtcaaaaataatggcgtaacgttaacaggtggcgcgtttaacgcaggcgccacgttggtggtggattaccaatgaaaaaaatagttttgacgatgttaatggggggcagccttgccgcacaggcagccgataatcttaagtttcacggcacattaatttcaccgccgaattgtacgattaacaatgatcagacgatcgacgttaagttcggtaacctgctgattaataaaatagatggtacgcgttatgcgcagaatgttccgtatgagatcacctgtgattcaacggtgcgcgatgagacgatggcgatgaccctgacgctaagcggttccgtgagtgattttaatccggcggcggtaaacaccagcgtggcggggctggggattgaactcaggcagaacgaccaaccctttacgttggggtccaccattacggtgaatgaacaatcgatacctgttctgaaagccataccggttaaaaagagcggtgcttcgctgaaagaaggcggcttcgatgcgacggcaacattacaggtggattatcagtaatggctaaaagacaggcgttattacacggcgcggcctgcatcctctgtggggcgctgatattgccggtctcagcggcagataacctgcatttttccggtagcctggtggccagtccttgcacgctcacgatgcaggggacggggattgccgaagtcgatttttcgtcgcttgacagttctgatttcactcccgacggccagtctgctcgtaagcctttggtgtttgaactcacggattgcgattcggcgctgagtaacggggtgcaggtgactttcactggaaccgaagcgaccggaatgcgcggtatcctggccatcgatagctattcaggcgcttccgggatcgggattggtattgaaacgctatccggcgttcccgtgggcatgaacgataaagagggtgcgatatttacgctggtgacggggaaaaatacgctaaacctgaatgcctgggtacaacgtcttcccggcgaggacctgattccgggaaggttctctgcaagtgcgctagccacatttgagtatttataatgaaaataatacggactttatttttgctgctgattgccgtttatggcagttcggtagtggccaaacccatgctgaaagcgacgttttcaagcaccacgatgtattatggtattggccctaatagcgacaaatctattgtggcggaggtgacgatagcgactccggagggagtgtactatggctcctggaacctttcgggacatcgtaaaggagaaacgctaaccgcagactcctggtctgggccagaacctgcgccgaaggttgtattgaaggattttgataacactgtttcgcgatctgcgtgcaagaatcttccctcgaactggagggggtgtggttcttttaccctggagattacggtacaaagcgatgattatggttgcccctggctggcgtcgagccatatcgttgctaccacttttatcactaacgaaacgtattccccgccggatacgcgcagttcagtttgcccgaaagttcccgttgatacttttgatatctcctgggatgcgaacgtttcgaaacagaaaacaaccctcatgcttgatgccaccggtggcacggtgaatcgcacgttacatacctatttgatggaggggggaaaactgtgcgatggcagcaaatttgacaaccgtggcgcttattgccgttttgtctcatcgggtattacgctcaatgtgctgggctgcgaccagtcgagcgtcacgaccagcgccgttgatcatccgataaccgatgttgagcttcatgacattaatgtagcggtgaacacccgcaacattggctccgggcagttcacgtcgacctgtagcttccagtatattattgatgagctttaggggggctgggtgtttggcgaagattcacgctaacctggtatgaaccaaaaaaaaaccgggtggcggcttcgccttacccggcctacgttgtttctggacgttctcttttacagtttcgcaaacacccgacgcgcggcgtcaatagtattattaatgtcgtccatgctgtgtgcgaccgacataaagcccgcctcaaacgccgatggcgccagatatacgccttcctccagcatcaggtggaagaaacgcttaaagcgttccacgtcgcacgccatcacgtcctgatagcaggttacgctctcagcgtcggtgaagaaaatcccgaacatgccgccgacatggttgacgaccagtgggatccccgcctcctgcgccgcttcgcacagcccttccgccaggcgggtggtgagctcatccagcgtttcatgaatgccgggctgggcgacttcattcaggcaggcgaaaccggccgccatcgcaatcgggttgccggaaagggtgcccgcctggtaaaccgggcccgtcggcgccagcgcatccattacatcgcgacgaccgccaaacgcgcctaccggcatcccgccgccgatgattttacccagacaggtcaggtccggcacgacgccgtagtaatcctgggctccggccagcgctacgcgaaaaccggtcattacttcgtcgataatcagcagcgcgccgaactcatcgcacaaggcgcgcagacctggcagaaattccggcagcggcgggacgcagttcatattgcccgccacgggttcgacgatgatactggcgatttcctgcggatattgttcaaatgccgcgcgcactgacgtcagatcgttataagtgcaggtcagcgtatgtttcgcgaaatctgccggcacgcccggcgagttcggctgaccgagcgtcagcgcgccagaaccggctttgaccagcagacagtctgcgtggccgtggtagcagccttcgaatttgataatcttatcgcggccagtaaaaccacgcgccaggcgaatagcgctcatcgtcgcttcggtgccggagttcaccatgcgcaccatgtccatggtcggcaccaggttggtgaccagttccgccattttcacttccatttcggttggcgcgccgaagcttaaaccgcgctccgcagcttcgatcaccgcattgcggatagccggatggttatgccccagtaccattggtccccaggaaccgacatagtcgatatacgctttgccatcgacatcataaagataagcgccgtccgctttttcgataaacagcggggtgccgcccacgccagtgaaggcgcgaacaggggagttcacgccgccggggatcagctcgcgggccgcgctatagagattttcagacttactcatggaaagattcctggttcgtagaaaaagtgaatacccgctattctaagttattcagagaaggttatgaaagttttacgcatttgaaacaatacgatttgcaggggattttcgcggcgttggcgagtagaatgccgactttagatttgtattaccaattaatgatcttctgatgaaaacagacacttccacctttttagctcagcaaattgtgcgtttacggcgcagagatcagattcgccggttaatgcagcgggataaaacgccgctggccatcctgttcatggcggccgttgtcggcacgcttaccggactggttggcgtcgcctttgaaaaggcggtttcctgggtacaaaacatgcgcattggcgcgctggttcaggtcgcggaccatgcgtttttgctttggccgctggcctttatcctttcggcgttactggcgatggtcggctactttttggtgcgaaaatttgcgccggaagccggcggctcgggtatcccggaaattgaaggtgcgctggaggagttacgtccggtgcgctggtggcgcgtgttgccggtgaagtttatcggcgggatgggaacgttgggcgcaggaatggtattagggcgcgaagggccaacggtgcaaatcgggggcaacctggggcgcatggtgctggatgtttttcgtatgcgcagcgccgaagcgcggcatacgttgctggcgaccggcgcggcggcggggctctctgcggcgtttaacgcgccgctggcgggtatcctgtttattattgaagagatgcgcccgcagtttcgctacaacctgatttcgattaaagcggtgtttaccggcgtcatcatgtcgagcattgtgttccgcatatttaacggcgaagcgccgattattgaagtcggcaaactgtctgatgcgccggttaacacgctgtggttataccttatcctcggtattatttttggctgcgtcgggccggtatttaattcgctggtgctgcgtacccaggatatgtttcagcgctttcatggcggcgaaattaaaaaatgggtgcttatgggcggcgcgatcggcggcctgtgcggtattctggggttgattgagccggccgcggcaggcggcggatttaaccttattcctatcgccgcggcaggtaattttagcgtcgggctactgctgttcatctttattacccgggttgtcacgacgctgctttgcttttcttccggcgcgccggggggcattttcgccccgatgctggcgctgggaacgctgcttggtacggccttcggtatggcggcggcagtgcttttcccgcagtatcacctggaggccggtacctttgcgattgccgggatgggggcgctgatggcggcgtcggtgcgcgccccgttgacagggattgtgctggtgctggagatgaccgataactatcagctcattttgccaatgattatcacctgtcttggcgcgacactattagcccagtttttgggcgggaaaccgttatactcaaccatcctggcgcgcactctggcgaagcaggatgcggaacaggcggagaaaaaccagaatgcgcctgcggacgagaatacttgaacgaattaccagggtattagataatgactgccaatattgggtgaaaatttatccaattaccgatgtcgtttggagcaaaatatgagtgatgacgtagcgctgccgctgcagtttaccgacgcagcagcgaataaagtaaaaagtcttatcgctgacgaagataacccgaatctgaaactgcgcgtgtatatcaccggcggtggttgcagcggcttccagtatggttttacctttgacgatcaggtgaacgaaggggatatgaccatcgaaaaacagggcgttggcctggtggttgacccgatgagtttgcagtatctggtgggtggttcggtagattataccgaaggtctggaaggttcccgcttcattgtaaccaacccgaatgcgaaaagtacctgcgggtgtggctcttccttcagcatttgattgctgttcgttgtgccggatggcgacgcgagcgtcttatccggcctacaggaaagatgttccaggcccgataagcgtagcgccatcgggcaaaacaatatcaacgtccgttttcatccagggcaaacgtcggcaatttcaaatgccagcgaatggccgccagccgaatgaacagcgtgaccaccatacccatcatgctggcgctttccagcggtactgaaaacgtataaaacgcggtggcgtgaacaatcccgccgataatacaggccgtggcatagatttcggtgcgtaggatcatggggatctcgcgtgccagaacatcgcgaataatcccgccgccgacgccggtaatcacgcccatacagacagccactaatggccccgtttcagcgaggaaggctttattcaccccaatgccgacaaacaccgccagcccgaccgcatccagtaccggcaacatccatttcggtagacgtcttggctggcgaaccagtaggatggtcagcatactggtgaccatggcgacgaccaggtcggtaggatctttaacccagaataccgggccgttatccagcgccatatcgcggattgtcccgccgccgacggcagtaacgacgccgagcaccaggacgccgaacgggtccatacgtaatttcccggccagcaacacgccagagatagcaaatacagccgtgcctacaatatccagccaatagacgagcattgtcgaatccccactgggagcctggtaagacaggctctaattcacctgtgaaagcgcattacagagttgttttgcggcgaggataatacgcgggcttgcgcgttcaaaccagtcgctgttaagcggaataaccggaatttttaacaggtttccccagtattgttcaattttgagaatttcgcccgcttttccggccacgataatggcctggggatgccttgccagcacctgctcacggctgacttgcggccacggcacgcggctgtcagcaaagacgttttctccgccgcaggtcgtcaaaacctgatgttgaatagaccctttaccactggtaaacagaggattcatgccaaactgaagaaagacgcgctttttagctttaccggcatactcggcgttgagcgcggcgtactcgtttagcaatgtctgcgctgcctgctgagccttttccggctgcgggctccaggcggccagttgacggagcgtgtcggcgatctgttcgatggttaccgcgtccacccacatgaccttaatacctaatgacgtcagttggtttacctggcgttccgcattaccgccgcgccaggcgacgaccagatccggcttcagcgccacaatgcgttccagattcattccctgccaggtagagacttgttctattttttgcgcttcgggcgggtagtcggaatagctgctgacgccaacgggcgtaatcccggcggcaaaagcgagctccgtattggcgggagagagggtaatgacgcgcggcgcagcgtaaagccacaccgggagcgtaagcagcagggcgaccagcgccctgaacatttgcttagccatgcgccagtttctgtaccagcgtttcgaccatcagagtcgactgtttcgccgccaccgcgaggaattcgtcaaagctgaggtgcgattgctgatcggccacgtcagaaatagcgcgaaccaccacgaacggcacgttgaagttatggcagacgtgggcgatagcggtggcttccatctctacggcgaccgcgtcggggaagttatgccggattttcgccagcccgacggaaccgttaataaacgcgtcgccgctaacaataaggccgcgtaccgcgttcagattcagctctctgatgcaggattccgcggcggcgatcagtttgtcatcggccttaaatccggccggacagcccggtaattgcccgtattcatagccgaaagcggtcacatcagcgtcgtggtaacgcgcttcgtcagagacgacgatatcgccgaccttcagcgtggacgccagaccgcctgcggaaccggtattgatgatcacgtccggcttgcagtgctccagaagcaacgttgcgcccagcgccgccgcgactttaccgataccggatttcagcaacgccacttcggtgccgttcaactggccagtgtaaatttcgcagccgcccagcgtaatcgtctgacggttgtcaattttgtcacgcagcagcgtaacttcttcttccattgcgccaatgatgccgattttcatagatttactcgcgataagtcagttttgggggcatagtttatcatgcgcttatggggaagcgcatttctcaggcggggagaggatatggcatcgatcgatttccgaaataaaattaactggcatcgtcgttatcgttcaccgcagggtgtaaagacggagcatgagatcctgcggatttttgaaagcgatcgcgggcggattatcaactctccggctatacgccgtttgcagcaaaaaacgcaggttttcccgctggagcgcaatgccgcggtgcgtactcgcctgacgcattcgatggaggtgcagcaggtagggcgttatatcgcgaaagagattttaagccgtctgaaagagcaagaccgactggaggagtacggcctggacgcgctgaccggtccctttgaaagtattgtggaaatggcctgcctgatgcacgacatcggtaatccgccgttcggtcattttggcgaggcggcgatcaatgactggtttcgtcagcggctgcatccggaagatgcggaaagtcagccgctcacgcatgatcgctgtgtggtttcctcgctacggttacaggaaggcgaagaaaatctgaacgatattcgccgcaaggtacgtcaggatatctgccattttgaaggcaatgcacagggaattcgtctggtacatacgctcatgcggatgaatcttacctgggcgcaggtcggcggaattttaaaatatacccgtccggcatggtggcgagggccggtgccggattcccatcgctatttaatgaagaaaccgggctattatctttctgaagagaagtatattgcgaggttacgtaaagaactgcagttagcgccttacagtcgctttccattaacgtggattatggaagccgcagatgatatttcttattgtgtcgccgatcttgaagacgcggtagagaaaagaatctttagcgttgagcagctttatcaccatttatatcacgcgtggtgccaccatgagaaggattcgctgtttgagctggtggtaggaaatgcgtgggaaaaatcacgcgccaatacattaagccgcagtaccgaagatcagttttttatgtatttacgcgtaaatacattaaataaactggtgccctatgccgctcagcgttttattgataatttgccgcagatttttgccggtaccttcaatcaggcgttactggaagatgccagcggttttagccgcctgcttgaactctataagaatgtggcggttgagcatgtgtttagccatccggatgtagaacagcttgaactacagggataccgggtgatcagcgggttattagatatctatcagccgctattaagcttgtcgcttaacgactttcgcgagctggtggaaaaagaacggttgaaacgcttccccatagaatcgcgcttatttcagaaactttctacgcgccatcgtttggcctacgtggaagtcgtcagtaaattacccacggattcggcggagtacccggtactggaatattattatcgctgtcggttgattcaggattatatcagcgggatgactgacctttacgcatgggatgaatatcggcgtttgatggcggtcgaacagtaaatggacttttgtaaagatggacaataaatttttactttttccagaaactttattccggaacttcgcgttataaaatgaatctgacgtacacagcaattttgcgttacctgttaatcgagattgaaacacatgaaaaaaaccacattagcaatgagtgcactggctctgagtttaggtttggcattgtcgcctctgtctgccacggcggctgaaacgtcctcttcagcaatgactgcccagcagatgccaagcctggcaccgatgctcgaaaaagtgatgccatcggtggtcagtattaatgttgaaggtagcaccacggtgaatacgccgcgtatgccgcgtaatttccagcagttctttggcgatgactccccgttctgccaggacggttctccgttccagaattctccgttctgccagggcggcggtaacggcggcaacggcggtcaacaacagaaattcatggcgctgggctccggcgtaattattgacgccgcgaagggctacgtcgtcaccaacaaccacgtggttgataacgccagcgtgattaaagtacagcttagcgatgggcgtaaattcgatgctaaagtggtgggcaaagatccgcgttctgatatcgcgctgattcaaattcagaatccgaagaacctgacggcgattaagctggcggactccgacgcgctgcgcgtgggggattataccgtcgctattggtaacccgtttggtctgggcgaaacggtgacgtcaggtatcgtttcggcgctggggcgtagcggcctgaacgtagaaaattacgagaactttattcagaccgacgccgcgattaaccgtggtaactccggcggcgcgctggtgaacctgaacggtgagctgatcggtattaacaccgcgattctggcgccggacggcggcaacatcggtatcggcttcgctatccccagtaacatggtgaaaaacctgacgtcgcagatggtggaatacggccaggtgaaacgcggcgaactggggatcatggggactgagctgaattccgaattggcgaaagcgatgaaagtcgacgcccagcgaggcgcgttcgtcagccaggtgatgccgaattcgtccgcggcgaaagcgggtatcaaagccggggatgtcattacctcgctgaacggtaaaccgatcagcagctttgcggcgctgcgcgctcaggtcggcactatgccggtcggcagcaaaatcagcctcggtctgctgcgtgaaggtaaagcgattacggtgaatctggaactgcagcagagcagccagagtcaggttgattccagcaccatcttcagcgggattgaaggcgctgaaatgagcaataaaggccaggataaaggcgttgtggtgagcagcgtgaaagcgaactcacccgccgcgcaaattggcctcaaaaaaggcgatgtgattatcggcgctaaccagcagccggtgaaaaatatcgccgagctgcgtaagattctcgacagcaagccgtcggttctggcgctgaatattcagcgtggtgatagttctatttatttgctgatgcagtaatcacctttgtcccccttccgccatggaagggggcaacacttttctgtgaaaccccccacaactccatacttatttgcaccgttttgtgcatttgcacaatgtcgagacctgtcatcttccttatgcttgtgctctgctcacaggagggatttatggctggctggcatcttgataccaaaatggcgcaggatatcgtggcgcgcactatgcgcatcatcgataccaatatcaacgtaatggatgcccgcgggcgcattatcggcagcggcgatcgggaacgtattggtgaattgcacgaaggcgcgctgttagtgctgtcgcagggccgggttgtggatatcgacgacgccgtggcgcgacacctgcacggggtgcgtcaggggattaatcttcccttacgtcttgagggcgaaattgtcggcgtgatcggcctcaccggcgaaccagagcacctgcgtaaatatggcgaactggtgtgtatgactgccgaaatgatgctggagcagtcgcggttaatgcaccttttggcgcaggatagccgtttgcgcgaagagttggtgatgaacctgattcaggccgaagaaaatacgccggcgctggtggaatgggcgcagcgtttggggatcgatttgaaccagccgcgtgtggcggcggtggtggaagtcgacagcggccagcttggcgtcgatagcgcaatggcggaacttcagcagttgcagaatgcgcttaccacgccggagcgtaacaacctgatagccattgtttctctcaccgagatggtggtactcaaacccgccttaaactcgtttggtcgttgggatgctgaagatcatcgtaagcgcgtagagcagcttatctcgcgcatgaaagagaatggtcagctacgttttcgcgtggcgctgggcaattactttaccgggccgggcagtattgcacgctcataccgcacggcgcgcaccacgatgatggtcggcaaacagcgaatgccagagagccgcagctatttttatcaggatttgatgctgccggtcctgttagatagcctgcgtggcggctggcaggccaatgagctggcgcgcccgctggtaaaactcaaagcgatggataacaacgggttattacgtcggacgctgacggcgtggtttcgccataatgtccagccgctggcgacctctaaggcgctgtttattcatcgtaacacgctggaatatcggctaaatcgtatttcggaactgaccgggctggatttgggaaattttgacgatcggctgttgctgtatgtggcgctacaactggatgaacagcgttaagcccggcggcgctacgcttatcaggcctacggggatatatctgtaggccggataaggcgtaacacgtcgccatccggcaacacacagcttacttacgggtaagcttgtccagatcggcttcgatttcactgatcttattcgcgacgacgctttccaggtggcgcaagtcgtcgaggatcttacgtttgagatcgagttctgagcggtcgcgctggcagatttggtccagctcgtcaatcacatagcgtaggttagggctaatctcctgtacctctttataaccctgaccgatgccatcggccaccaccgttttacgctggcgtggatacttaaacttcacgcttttagcaaagaattcacctctatccttttgaaaatagattttcaggatatcgttattggcttcttgccgcaggctgtaacgatcgatttcctcaggattggtaatgcccagactttttagattgtcatacatagcggtatccttcatcacactataacttttgaataattaacgaaaaattggtttttcgccaccagtgtatacaaaaaaagcgcggttgatcgcagaagacgtctcggcaacgtcatgagcaaaagggcggcggttattgatagcttaagtaattcaacgcgatattccgtttatagagaaagcgtttgaagtcagtgtgggaaattgaccggaggcagtggtcgataaccttgagaggcggagtctatgtccggaacgtataatgctactattcgccgggtggtggtttccgcctggataggaaactccattgaatattatgattttctattatacggcctggcaagcgcgctggtatttggcccgcttttttttcctggcgccagcccattgactgcaacgttatcttcttttgccagtttcggcgtgggatttatctcccgaccgctgggcgcgctattttttggcaacaggggagatacgcttgggcgtaaaaacacgttattaattacgttaggggggatgggcgcggtcacgtttctcatcggttgcctgccttcttacgccagtattggcgcgctggcgcctgctttactggttattctgcgttttctacagggatttatggttggaggcgaatggggaggcgccatgttgatggtcgtggaatatgctgctggaaagcaccgggggcggttaagcgcgctatcgcaaacaggaggactcacgggacaattattggcgacaggcgtatttatagtcgtgacccaattaccgcaggaggcgttgttatcgtggggatggcgtattccttttctgctcagtgcgcttttggtgttgcctggattatatatgcgtcatcgtctggatgagacgcctgtcttccgtgcgtttaaaaagcagcaggccattaatcataggcagcaaagagaagaaaggccggtggtcaaagtagtacgagaacaatggcgcagcattttgctgattataattctgcgttttgcggaaagcgttcccttttttcttgctaccgtcttcgcggtttcctgggcgacgacgcagcttgggattgccagcctgactattctgtacattgtaatgttcacctgtctgctggcgtatcccatgcacgtgctatttggcatcatgtcggatcggcgtggctgccgtcaggtgtatattttcggcgcgctttttgtcgcggcaatggcttttccctttttctggctgctggaaagccgttcgctcatactgatgacaatgggctacgttctgcttattaacattggtcataattcactgaatgccgtgcaaccttcttttttcgccggactgtttcatccgcctgtacgctacagcggttcatcaattggcgctcagttgggggcggttgtggcagggggattcacgccgtttatcgctaaagcgttaagcgcagtctatgataacagttgggcgttggttgccggttatgtcgttttgactgcgttggcttcggcgtttgcggcaaagattgcgccggaaaccgtgttaccgcattcgccgtaatgcaaaggggggctgtcgcccccgcttttcactcgcttaatcaatagtgcgcaataattcgttaatgcccactttaccacgcgttttggcgtcgacttttttcacgatcaccgcgcagtacaggctgtacttaccgtcttttgacggcaggttgccggaaacgaccacggagcccgccggtacgcggccatagtgaacttcaccggtttcgcgatcgtagattttggtactctggccgaggtatacgcccatggaaatgacggaaccttcttcgacaatgacgccttccacgacctcagaacgcgcgccaataaagcagttgtcttcaatgatggttgggttagcctgcagcggctccagtacgccgccgatacccacgccgccggaaaggtgaacatttttaccaatctgcgcgcaggaacccaccgtcgcccaggtgtcaaccatggtgccttcgtcaacgtaggcgccgatgttaacgtaagacggcatcagcacggtgttgcgggcgataaatgcgccctgacgaacggccgcaggcggaacgacgcggaagccttctttctgaaaacgcgcttcgtcgtaatcagcgaatttcatcgggactttatcgaagtagcggctttccgcaccgtcgataacctggttatcgttaatacggaaagagagcagaaccgctttcttcaaccactggtgagtgacccactgaccgtcgattttttctgcgacacgcagcgcgccggaatcaagtagagaaatgacctggtttactgcctctcgggtcacggtatctacattagccggcgtaatatcggcgcggcgctcaaaagcggtctcaataacgttctgtaactgctgcattgttaaactctttcatataaataaacacactaccctttatcgtttggattgagggccgctgtcaaccgttgttgcacctcaagttgcagcacattattaagtgcgcgccgatccgctgtggcgattatgaataaatcttctactcgttcaccaatggttgtaattcgggcgccatgaagcgaaattcccagatcggcaaaaatttgtccgaccctggccagcagaccaggttgatcgagcgcgatcaattccatgaatgattttctgtcggtatgggtgggcagaaaattgacttccgtttcgaccgtaaagtgccgtaactttgccggttgccgacgcggctgcggcggctgccagctacgctgcgtaatggtttgttcaagaccggtgcgaataacgtcatggcgatccgccgccagcgggctgccgtctggttccagaacaataaacgtatccattgccatgccgtcgcgagtggtaaagatctgcgcgtcatggacgcttaaattacgcctgtccagctcggcgcagacggcggcaaacagatagggtctgtccggactccagataaaaatttcggttccaccgcgcgtggcctgcggactgagcaacactaacggttggcgcagatcgtgctgcaataaatggcgtgcgtgccaggcgagctgatttggactatgacgaacaaaatagttagcgcgacagcgggtccagattttgtgcagcgcggcttcatcaatattgtccattcgcagcagcgccagcgcctgaagctgatggtgacgcacgcgctcacgcatatccggcgtattttgcattccacgcctgagctgtttttcagtggcgaagtacagctcgcgcagcaggctctgtttccagctattccacaaggtttcgttggtcgcgcagatgtccgcgacggtcaggcagaccagaaaacgcagccgtgtttcggtttgcacctcttcggcaaactgcttgatgacttccggatcctggatgtcgcggcgctgggcggtgactgacattagcaggtgttggcgcaccagccacgcgaccagttgcgtttcgcgtgagttcaaaccgtgcagttcggcgaaggtgagtacatcctgcgcgcccagtacggaatggtcgccgccgcgtcctttcgcaatatcgtggaacagcgcggcgatcaggatcagttccggatggggaagccgcggccagagatcgacgcatagcggatggcgctggcgcgtctcttctttcgcaaagctctccagtttgagcattacgcggatggtgtgttcatccaccgtgtatgcgtggaacaggtcaaactgcatttgtccgacgatgtgcgaccactgcggcatataagcccacagtacgctgtggcgatgcatgggcagcaggccgcggctgaccgcgccgggatggcgcagcatactcagaaacagagtgcgcgcctccgggatgtaacacagcggttggctcaggtggcggcgggcgtggcgcaagtggcgtaacgtcgtagagtagatgccggtgatcgcgctattgcgcaccatcatataaaacatgcgcaggatcgcttgcggttcgcggataaacagcgtgtcgtcacgcagatcaataagcgtgccgcgcagttgaaactcatcgtcaacaggacgtggtttttcatccgcaggtagcgccagaatcgcctcgtcaaatagctgaagcagcatctgattaagttcgctcacccgacgcgtaacccggaagtagtctttcatcatccgctcaaccggatcattgccctcgccgctgtagttaaggcgttgagcgacgcttaactggcggtcgaacagcaggcggttatcgtagcggctgaccaccagatgtagcgcaaagcgaatgcgccacaggatatgcaggcactcgttgagctccgcgcgctcagcgggggttaaaaagccgaatcccaccatctcatcgagcgaggtagcgccgaagtgacgtcgggcgacccactgtaacgtatggatatcgcgcaggccgccggggctgcttttaatatccggctccagattatagctggtaccgtgatagcgctggtggcgctggttctgctcttctactttggcggcgtaaaatttgtcggacggccaaaaaccttcgctgaaaatatgtttttgcagtgccagaaacagagcgacatcaccgatcagcaggcgcgtttcgatgaggtttgtcgcaacggttaaatcagacagaccttccagcagacactcttccagcgtacgtacgctatgcccgacatccagcttgacgtcccataataaagtcagcagctcgccgaccttttgcgcctgttcatcgggcagctttttgcggcttaaaatgagcagatcaatatcggaaagcggatgcagttcgccgcgtccatagccgccgacagcgaccagcgccagatcggcaatctgaccgaaaccggcctcaatccacaggcgttgcaataactggtcgataaattcggttcgggcttcaataagctgttcagcacaaatgccgctgtcaaatgcctctcccagccagtgttgaaagatgtcgatgcgggctttgataccggcgacggtcagttcagcgcgcggccagacgccagggttttgcggctggtcagggagggtggggagtgcggtattcgcgtgctgttcaggaagagtattcatatgcgccacccattaaaaagccggataatggcgtgaacgccttatccggcctacgtatttatcttcatccttcaagttgcttctacgttggctgcgctcgttcactccagtcacgtacttatgtacgctcctgaagattcactctcttgccgccttgaggcaactcgaatgattttgagtaaaggtgtaatttgtaggcctgataagatgcgaaggcatcgccatcaggcaaaacattattcgtcgtgtgtgatgatcgccgggatggtgtcatctttacgcagcgtcagaatttcacagccgttttccgttaccacaatagtatgctcgtactgagcagacaagctgcgatctttggttttcaccgtccagccgtctttcatggtgcggatacggtaatccccggcgttcagcatcggttcaatggtaaaggtcatgccaggctgcaacacgacgccgccatcgtctgcatcataatgcagcacctgcggttcttcatggaagccgcgaccaataccgtgtccgcagtattcacgtaccacggagaaaccttcgccttcggcatatttctggatggcggcgccaatggtgcgcaggcggatgcccggtttcaccattttgatgcccagatacaggctctcttgcgtgacgcggcacagacgctcgccgagaatggtcggtttgccgacgataaacatcttcgaggtatcgccgtggaattcatctttaatcacggtcacgtcgatgttgacgatatcaccatctttcagatgtttagcgtcatccggaatgccgtggcacaccacttcattaatagagatacagacggatttcggataaccgtgatagccgaggcaggcggagatcgcgtgttgttcgttaacgatgtaatcgttacagatacggtccagttcgccggtggtgacgcccggtttgatatacggttcgatcatttccagcacttcggctgccagacggcccgcgacgcgcattttttcgatgtcttcagatgtcttgatagagatagccatgaattctgtccatcagtgccgatgatttcggcaataattgtgtaagtgctgacaatggtatcagtcaggggtgtaccctgccaaattgagaatcattctgaacttcgcctttcgtgccacaggtgcgttggcgacattttttcaccccagtcactgactggccgtaagctcccggggatgcaaaaatttgctgcctgcctgtaacacgaaattcatcgttcaattcagcactgagtgccaacaattattggtgtcggtggcgtatttgtggtataaagcgcgccggacttccgatccattcgaagactacacacgatggacgggagcgacaaatctcactttgtgtaacaacacacacgtatcggcacatattccggggtgccctttggggtcggtaatatgggatacgtggaggcataaccccaacttaatctatagaggttttaaatcatggcaactgtttccatgcgcgacatgctcaaggctggtgttcactttggtcaccagacccgttactggaacccgaaaatgaagcctttcatcttcggcgcgcgtaacaaagttcacatcatcaaccttgagaaaactgtaccgatgttcaacgaagctctggctgaactgaacaagatctctgctcgtaaaggtaaaatccttttcgttggtactaaacgcgctgcaagcgaagcggtgaaagaagctgctaacagctgcgaccagttcttcgtgaaccatcgctggctgggcggtatgctgactaactggaaaacagttcgtcagtccatcaaacgtctgaaagacctggaaactcagtctcaggacggtactttcgaaaagctgaccaagaaagaagcgctgatgcgtactcgtgagcttgagaaactggaaaacagcctgggcggtatcaaagacatgggcggtctgccggacgctctgttcgttatcgatgctgaccacgagcacattgctatcaaagaagcgaacaacctgggtatcccggtatttgctatcgttgataccaactctgatccggatggcgttgacttcgttatcccgggtaacgatgacgcaatccgtgctgttagcctgtacctgggcgctgtcgctgcaaccgttcgtgaaggccgttctcaggatctggcttcccaggcggaagaaagcttcgtagaagccgagtaataaggcttgataactccctaaaatagttcgagttgcaggaaggcggcaagctcgagaattcccgggagcttacatcagtaagtgaccgggatgagcgagtgaaggcaacgcgcctgcggctcgaaatatgaaggggagagcccttatagaccaggtagtatcacgtttggttagggggcctgtatatggccccctttttcacttttatatctgtgcggtttgatgccgggcagatcaaatctttcgaggattttagaatggctgaaattaccgcatccctggtaaaagagctgcgtgagcgtaccggcgcaggcatgatggattgcaaaaaagcgctgactgaagcgaatggcgacattgagctggcaatcgaaaacatgcgtaagtccggcgctatcaaagcggcgaaaaaagcaggcaacgtggctgctgacggcgtaatcaaaaccaaaatcgacggcaacgtcgctttcattctggaagttaactgccagactgacttcgtggctaaagatgctggcttccaggcatttgctgacaaagtgctggacgccgctgttgctggcaaaatcactgacgtagaagttctgaaagcacagttcgaagaagagcgcgttgctctggtagcgaaaattggcgagaacatcaacattcgtcgcgtcgcttccctggaaggcgacgttctgggttcttaccagcacggtgcgcgcatcggcgttctggttgccgctaaaggcgctgacgaagagctggttaaacagctggcgatgcacgttgcggcaagcaagccggaattcgttaagccggaagacgtgtctgctgacgtggtagagaaagagtaccaggtacagctggacatcgcgatgcagtccggtaagccgaaagaaatcgcagagaaaatggttgaaggccgcatgaagaaattcaccggcgaagtttctctgactggtcagcctttcgtcatggaaccgagcaaatctgttggccaactgctgaaagagcacaacgctgacgtgactggcttcatccgctttgaagtgggcgaaggcattgagaaagtcgagactgactttgcagcagaagttgctgcgatgtctaagcagtcctgattttcctgaggagccgcctgagggcggcttctttttgcgcctctcttgtaaaatcagccgacgcctggcgtctgcgctgaaatgcgacgtacaatgtcgccggaattaactcatatcaatcgttgacagtctcaggaaagaaacatggctaccaatgcaaaacccgtctataaacgcattctgcttaaattaagcggcgaagctctgcagggtacggaaggcttcggtattgatgcaagcatactggatcgtatggctcaggagatcaaagaactggttgaactgggtattcaggttggtgtggtgattggcggtggtaacctgttccgtggcgcgggtctggcaaaagcggggatgaaccgcgttgtgggcgaccacatgggcatgttggccaccgtcatgaacggcctggcaatgcgtgatgcgcttcaccgcgcctatgtgaacgcccgcctgatgtcggcaattcctttaaacggcgtgtgcgacaactacagttgggccgaggcgattagcctgctgcgtaataaccgtgttgtgattctgtctgcaggtacgggtaacccgttcttcactaccgactctgcggcttgtctgcgcgggatcgaaattgaagcggatgtcgtactgaaagcgaccaaagtggatggcgtattcactgccgatccggcaaaagatccttccgcgaccatgtacgatcagctgacctacagcgaagtgctggataaagagctgaaagtgatggatctggcggcgttcacgctggctcgtgaccacaaactgccgattcgtgttttcaacatgaacaaaccgggcgcgctgcgtcgtgtggtgatgggcgaaaaagaagggacgttaatcacggaataattcccgtgagcgccaaatacgggtaagattctgttctattgacgggtcttattacctggcagaaattaaacgagactatacttagcacatctttatattgtgtgaccgtctggtctgactgagactagttttcaaggattcgtaacgtgattagcgatatcagaaaagatgctgaagtacgcatggaaaaatgcgttgaagcgttcaaaacccaaatcagcaaagtgcgcacgggtcgtgcttctcccagcctgctggatggtattgtcgtagaatactatggcactccgaccccgctgcgccagttggcaagcgtaacggtagaagactcccgtaccttaaaaattaacgtgtttgaccgttctatggggccagccgttgaaaaagcgatcatggcgtcagacctcggtttgaatccaagctctgcgggcaccgacattcgcgttccgctgccgccgctgaccgaagaacgtcgtaaagatctgacgaaaattgtccgtggcgaagcggagcaggcgcgtgtcgccgttcgtaacgtccgtcgtgatgcgaacgataaagtaaaagctctgctgaaagataaagcgatcagtgaagatgacgatcgtcgctctcaggaagaagtacagaaaatgaccgacgcggcaattaagaaagttgatgcggcgttggcagataaagaagcagaactgatgcagttctgattgatctgtacgcagatataaactcattccaccgctaacctggcggatgagtggtgtacaaagcgccgcgcagaagacattatcaggtctcctgtgcggcgttttgctttttattccgtttcaacacttctggacgtttcatgaagcaattaaccattctgggctcgaccggctctattggttgcagcacactggacgtggtgcgccataatcctgatagcttccgcgttatcgcgctggtggcgggtaaaaatgtcgcccgcatggcggagcagtgcctggagttctcgccgcgttatgccgtgatggacgatacgtcgagcgcagaacagctcaaaataatgcttcagcagcatggcagccgcaccgaggttctgagcggtcagcaggctgcctgtgagatggcggcgcttgatgaggtcgggcatgtgatggcggccattgtgggcgcggctggtttactgccgaccctggcggcgattcgcgcagggaagacgattctgctggcgaataaagaatcgctggtgacctgcgggcggctgtttatggacgaagtaaaacgcagcaacgcccggcttttacccgtcgatagcgaacataacgcgatttttcagagtttgccgcaatctattcagcataatctgggatacgctgaccttgagcaaaatggcgtaacgtcgattttgcttaccgggtctggtggcccgtttcgtgaaacgcccatgtgcgatctggcagcgatgacgccggatcaggcatgtcgtcatccgaactggtcgatggggcgaaaaatctccgtcgactccgccaccatgatgaataaaggtctggaatacattgaagcgcgttggttatttaatgccagcgcacgtcagatggaagtgttgatccatccgcaatcggtcattcattcgatggtgcgttatcaggacggcagcgtcctggcgcagcttggagaacctgacatgcgtacgcctattgcgcatacgatggcatggccgaatcgcgtcacgtccggcgcgcagccgctcgatttttgcaaactcagcgcgctgacgtttagcgcgccagattatcagcgttatccttgcctgaagctggcgatggaggcgtttgagcaaggtcaggcggcaacgacggcgctcaatgcggcaaacgaaatcaccgttgccgcgtttctggcgcaacagattcgttttaccgatatcgccgggctcaatttagcggtgctggagaggatggatttacaggaaccggcaagcgttgaggacgtattgcaggttgacgccatcgcgcgtgaagtagccagaaaacaagtgatacggctctcacgctgacgattatcccgcgacagaagatcgtgctatttgttagcgttgggcttcggtgatatagtctgcgccacctgatcgcaggtttttggcttttttcggtcaggttagccgtggttttacacggcttttttgtggatacacaaaatcattcaggacgcatcgggacggcaggcgagtacgttcccggcgtgcgcagacagcgcacgacaggggcgatgacgcgcggtcatccgcgaagcgaaccgaagagaatgtgtataaaggcttcagtattcctgagtaccgctaaatcctttcagggacaaaaaacgcgttatgttgtctgcaactcaaccagtaagcgaaaatttgccagcgcatggctgccgtcatgttgcaataattatggatggcaatggtcgctgggcgaaaaagcaagggaagatccgggcctttgggcataaagccggggcgaagtccgtccggcgagcggtctcttttgctgccaataacggtattgatgcgttaacgctgtatgcctttagtagtgaaaactggaaccgaccggcgcaggaagtgagcgcgttaatggagctgtttgtgtgggcgctggatagcgaagtcaaaagcctgcaccgccataacgttcgcctgcgtattatcggcgatatcagtcgattcaactcacgtttacaagaacgtattcgcaaatcagaagcgcttaccgcccataatacgggtctaacgctgaatatcgctgcgaattacggcggacgttgggatattgtccagggagtccgacaactggcggaacaggtgcaggctggagtgctgcgccccgatcagattgatgaagagagactaggccagcaaatctgtatgcatgagctggcgcctgtggatttagtaattaggactgggggagagcatcgcattagtaactttttgctttggcaaattgcctatgccgaactttactttacggatgttctttggcccgatttcgatgaacaagactttgaaggtgcgctgcatgcctttgctaatcgagagcgtcgtttcggcggtaccgagcctggtgatgacaaagcctgatgggggttgcttttgctgaagtatcgcctgatttctgcttttgtgttaatacccgcggtcatcgctgcgctttttttattgccgccggtggggttcgccattattacgctggttgtctgtatgctggccgcgtgggaatggggacagttaagcggtttcgccgcgcgttcacagcgggtttggctggcggtgctgtgtggtctgttattggcgctgatgctatttttgttgcctgagtatcatcacaacattcgtcaaccgctggttgagatgtcgctttgggcatcgttaggatggtgggttgtcgcgctactgctggtgctattttatcccggttcggcggcaatctggcgcaactcaaaaacattgcgtctcattttcggtttgttaactattgtgccatttttctggggcatgctggcgctgcgcgcctggcactatgacgagaatcattacagtggcgcaatatggctactctatgtcatgatcctggtctggggagcggactctggcgcgtatatgtttggtaaattatttggcaaacataagctggcgccgaaggtttccccgggtaaaacctggcaagggtttatcggcgggcttgctacggctgccgtgatctcatggggctacggtatgtgggcgaatctgaatgttgcgcctgttatcttgctgatttgctctgtggtggcggctctggcttctgtactgggcgacctcaccgagagtatgtttaagcgcgaagcaggaattaaggatagcggccacttgattccaggccatggcggcattctggaccgaattgacagtctgacggctgccgtaccggtctttgcttgcctgttgttactggtgttcaggacgctctaacggaaggttttatgctgagtattctctggaatctggctgcattcatcatcgcactgggcgtgctgatcactgtgcatgaatttggtcatttctgggttgcccggcgctgcggtgtgcgagttgagcgcttttccatcggttttggcaaagcgctctggcgtcgtaccgatcggtacggcaccgagtatgtcatcgccctgatcccgctgggcggctacgtcaaaatgctggatgagcgcgccgaaccggtagcgccggaattgcgtcgtcacgccttcaataacaaaacggtgggccagcgcgccgcaattattgccgcaggtccggttgcgaacttcatttttgctatctttgcttactggctggtctttatcatcggcgtccctggcgttcgtccggtcattggcgaaataacgcccaactcgattgctgcgcaggcgcaaattgcgcctggtacggaacttaaagccgttgatggtatcgaaacccctgattgggatgccgtgcgtttacaactggtgtccaaaattggcgatcagcagacgacggtgagcgtcgcgccgtttggtagcgaccagcggcaggataaaacgcttgatttacgtcactgggcatttgagcctgataagcaagatcctgtatcttctttagggattcggccccgcgggccacagattgaaccggtactgtcagaagtgcaggcgaattccgcagccagtaaagcgggtttgcaagcaggcgacaggatcgttaaagtcgatggtcagccgttaacgcagtggatgaaattcgtgacgtttgtacgcgataatcccggtaagccgttagcgttagagattgaaaggcaggggagcgccttgtcgttgacgttaacgccggatacgaaatcggttaacggaaaggcggaagggtttgcaggcgtggtgcctaaaattattcctctgccggaagagtacaagactatacgccagtatgggccttttagcgccatcctcgaagccacggataagacgtggcagttgatgaagctgacggtcagtatgctgggtaaattgataaccggtgatgtgaaactgaacaacctcagtgggccgatttctatcgctcagggggctgggatgtcagcggagttcggggtgatttattacctgatgttccttgcgctaatcagcgtgaacttagggataattaacctgtttccgctgcccgttcttgacggggggcatctgctgttcctggcgattgaaaagcttaagggcgggccggtatccgagcgggttcaagactttagttatcgcattggctcgattttgctggtgttgttaatggggcttgcacttttcaatgatttctctcggttgtaagagagttagttaggaagaacgcataataacgatggcgatgaaaaagttgctcatagcgtcgctgctgttcagcagcgccaccgtatacggtgctgaagggttcgtagtgaaggacattcatttcgaaggcctgcagcgagtcgccgttggtgcggctctcctcagtatgccggtgcgcacaggcgacacggttaatgatgaagatatcagtaacaccattcgcgctctgttcgccaccggcaactttgaggacgtccgcgtcctgcgcgatggtaatacccttctggttcaggtaaaagaacgtccgaccattgccagcatcactttctccgggaacaagtcggtgaaagatgacatgctcaagcaaaacctcgaagcgtctggcgtacgtgttggcgagtctctggatcgcaccacgttgtctgatatcgaaaaaggtctggaagacttttactatagcgtaggtaaatacagcgccagcgttaaggcggtcgtcacgccgctaccgcgcaaccgtgttgatcttaaactggtgttccaggagggcgtatcggcgaagatccaacagatcaacatcgtcggtaaccatgcctttagcaccgaagaactcatttctcatttccagttgcgtgacgaagtgccgtggtggaacgtcgtcggcgatcgtaaataccagaaacagaagctggcgggcgaccttgaaaccttgcgcagctactatctggatcgcggctacgcgcgtttcaatattgactccacgcaagtgagtctgacgccggataagaaagggatctacatcaccgtcaatatcaccgaaggcgatcagtacaagctttccggggttcaggtgagcggtaacctggccggacattccgctgaaattgagaacctgacgaaaattgaaccgggcgagctctataacggcaccaaagtgaccaaaatggaagatgacatcaaaaagcttctgggtcgctatggttacgcctatccgcgcgtgcagtcacagcctgaaattaacgatgctgacaaaaccgtaaaactgcgcgtaaacgtcgatgcgggcaaccgtttctacgtgcgtaagatccgctttgaaggcaacgacacctcaaaagattccgttctgcgccgtgaaatgcgccagatggaaggggcgtggctgggcagcgacctggttgaccaggggaaagagcgtctgaaccgtctcggcttctttgaaaccgtcgacaccgacacgcagcgcgttccgggtagcccggatcaggttgatgtggtgtacaaggtgaaagagcgcaacaccggtagctttaacttcggtatcggttacggtacagaaagcggcgttagcttccaggccggcgttcagcaggacaactggttaggtaccggttattccgtggggattaacggcaccaaaaacgactaccagacctacagcgaactgtccgttactaacccatactttaccgttgacggcgtgagcctcggtggtcgtatcttctataacgacttccaggcggacgacgcggatctatccgactataccaacaagagttacggtacggatgtgacgcttggcttccccatcaacgagtacaacacgttgcgtgctggtctgggttatgtccataacaaactgtccaacatgcagccgcagatcgcgatggatcgttatcttgagtcgatgggacaatctgctgataccagcagttttgccgctgatgacttcacctttaactacggctggacctataacaagcttgaccgtggttatttcccgacggacggttcgcgcgtcaatctgacggggaaagtgacgattccaggttccgacaacgaatactacaaagtgtcgctggataccgcgacctatgtgcctatcgataacgatcacaagtgggtggttctggggcgtactcgctggggttacggcgatggtttaggcggcaaggaaatgccgttctatgagaacttctatgccggtggttccagtaccgtgcgtggtttccagtcgaatactatcggcccgaaagcggtctataaaaatggcgcccatactagttgggacgataatgatgattacgaagactgtactcaggaatcaggctgtaaatcagatgatgcggtaggtggtaatgccatggctgtcgccagcctggaatttattaccccgacgccgttcatcagcgaaaagtatgccaactcggttcgtacctccttcttctgggatatgggtaccgtttgggatacgaactgggatccgtcatctgcgccgtcagatgtaccggattacagcgatccaggcaacatccgtatgtccgcgggtatcgcattacaatggatgtccccattggggccgttggtcttctcctacgcccagccgtttaaaaagtacgatggagacaaagccgagcagttccagtttaacattggtaaaacctggtaattgttcactgcaaaggaatgcattggtagtgtagcgatgacttttggcgatgcccccagggatcgccaggccacgcaaagagctgtaccttcgggtgcaaatgggatggtaaggagtttattgtgaaaaagtggttattagctgcaggtcttggtttggcgatggtaacgtccgcacaggctgctgacaaaattgcaatcgtcaacatgggtaatctgttccaacaggttgcgcagaagacgggtgtatccaatacactggaaaacgaatttaaaggccgtgcggctgaactgcaaaaaatggaaaccgatctgcaatctaaaatgcagcgtctgcaatccatgaaagcaggtagcgatcgtactaagctggaaaaagacgtgatgtctcagcgccagactttcgcacaaaaagcgcaggcttttgagaaagatcgcgctcgtcgttccaacgaagaacgcaacaaactggtgactcgtatccagactgcggtgaaaaaagtggctaacgaccagagtatcgatctggtggtagacgcaaacaccgttgcttacaacagcagcgatgtgaaagacatcaccgctgacgtactgaaacaggttaaataagtaatgccttcaattcgactggctgacttagcagaacagttggatgcagaattacacggtgatggcgatatcgtcatcaccggcgttgcgtccatgcaatctgcaacaacaggccacattacgtttatggtgaatcctaagtaccgtgaacacttaggtttatgccaggcttctgcggttgtcatgacgcaggacgatcttccttttgctaagagtgcggcgctggtagttaaaaatccctacctgacctacgcgcgcatggcgcaaattttagatactacgccgcagcccgcgcagaatatcgcgccaagcgccgtgattgatgcgacggcaacgctgggtagcaatgtttcagtcggcgcgaatgcggtgattgaatctggcgtacaactgggcgataacgtggttatcggcgcaggctgtttcgtcggaaaaaatagcaaaatcggggcgggttcacgcttgtgggcgaacgtaacgatttaccacgacattcagatcggtgagaattgcctgatccagtccagtacggtgatcggcgcggacggttttggctacgctaacgatcgtggcaactgggtgaagatcccacaactgggccgggtcattattggcgatcgtgtcgagatcggcgcttgtaccaccattgaccgtggcgcgttggatgatactgttattggcaatggcgtgattattgataatcagtgccagattgcacataacgtcgtgattggcgacaatacggcagttgccggtggcgtcattatggcgggtagcctgaagattggccgttactgcatgattggcggcgccagcgtgatcaatgggcatatggaaatatgcgacaaagtcacggtaactggcatgggtatggtgatgcgtcccatcacggaaccgggcgtctactcctcaggcattccgctgcaacccaacaaagtatggcgtaaaactgctgcactggtgatgaacattgatgatatgagcaagcgtctcaaagcgattgagcgcaaggttaatcaacaagactaacgttccgccttgtagttgccattcttttccggcctgtcacattcatacgattgcggcaggccgtgttattattgcctttttgtatatttggacaggaagagtattttgactactaacactcatactctgcagattgaagagattttagagcttctgccgcaccgttttccgtttttactggtcgatcgcgtgctggactttgaagaaggtcgttttctgcgtgcggtgaaaaatgtctccgtcaacgagccgtttttccaggggcatttcccgggcaaaccgattttgccaggcgtgctgattctggaagcgatggcgcaggcaaccggtattctggcgtttaaaagcgttggtaaactggaacctggcgaactgtattatttcgcgggtattgatgaagcgcgctttaagcgtccggtggtgccaggcgatcagatgatcatggaagtcactttcgagaaaacgcgccgtggcctgacccgctttaaaggggttgcgctggtcgacggtaaagtcgtgtgcgaagcaaccatgatgtgtgctcgtagccgggaggcctgattcgtgattgataaatccgcctttattcatcctaccgccattgtggaagacggcgctgtaattggcgctaatgcccacattggtcccttttgtattgttgggccgcaggtcgaaattggtgagggaaccgtactgaagtctcatgtggtcgtgaatggtcaaaccaaaatcggccgcgacaacgagatttatcagtttgcctccatcggtgaagtgaaccaggatctgaaatatgcgggtgagccgacccgtgtggaaattggcgatcgtaaccgcatccgcgaaagcgtcaccattcatcgtggtacagtgcagggcggtgggttgacgaaggtgggtagcgataacctgctgatgatcaatgcgcatgtcgcacatgattgtacggtaggtaatcgctgtatcctcgccaacaacgccacgctggcggggcacgtatcagtcgatgattttgcgatcatcggcggtatgacggcagttcatcaattctgcattatcggtgcgcatgtgatggtcggcggctgctccggcgtggcgcaggatgtccctccgtatgtgattgcgcagggtaaccatgcgacgccgttcggggtaaatatcgaagggctgaagcgtcgcggctttagccgtgaagggctggtggcgattcgtaatgcctacaaactgttgtaccgcagtggtaaaacgctcgacgaagcgaagctggaaatcgctgaacttgctgaaaagcatccggaagtgaaggcgtttaccgagttctttgagcgttcaacgcgcggtccgattcgttaatggcggcacagcgtcctttaacgattgccctggtcgccggtgaaacgtccggcgatattcttggcgcaggcttaattcgtgcgctgaaagcgcgcgtacccaacgcccgttttgtgggcgttgcggggccgcgtatgcaggccgaagggtgtgaagcctggtacgagatggaagagctggcggtcatgggcattgttgaagtgctcggacgtttacgccgtttgttgcatatccgcgccgatctgacccgccgttttaccgaactcaagcccgatgtctttgtcgggattgatgcccctgatttcaatattaccctcgaaggtaatctgaaaaaaaaagggattaagaccattcattatgtcagcccgtccgtttgggcctggcgacagaaacgcgttttcaaaataggcagatccacccatatggtgttggcttttctgcctttcgaaaaagcgttttacgataaatttaacgtcccgtgccgctttatcggtcacaccatggcggatgccatgccgctggacccggataaaaatgcggcgcgcgacgtgctgggtatcccgcatgacgcccattgtctggcgctactgccaggcagccgtggcgcggaagtggaaatgctcagcgccgatttcctgaaaaccgcacaattgctgcgacagcgctatcccgatctggaagtggtagtgccgctggtgaacgcgaaacgccgcgagcagtttgaaaaaattaaagcggaggttgcgccggatctcgccgttcatttgctggacggcatggcgcgcgaggcgatgatcgccagcgacgcggctctgctggcctcgggtacggcggcactggagtgtatgctggcaaaatgcccgatggtagtgggatatcgtatgaagcccttcactttctggctggcgaaacgtctggtgaaaacggagtatgtgtctttgcctaacctgctggcgggaagagaattagtcaaagagctgttgcaggaagagtgcgaaccgcaaaaactcgccgaagcgctgttgccgctactggcgaacggtaaaaccagccatgcgatgcacgacaccttccgtgaattgcatcagcagatccgctgtaatgccgatgagcaggcggcagatgccgtcctggagttagcacaatgatcgaatttgtttatccacacacccatttagtggcgggtgtggatgaagtgggccgtggcccgctggtgggcgccgtagtgaccgccgccgtgatcctcgatccggcgcgtccgatcgtcggtctgaatgattccaaaaaattgtctgaaaagcgtcgtctgtcattgtatgacgagattaaagaaaaggcgttaagctggagtctggggcgcgcggaagcgcatgaaattgatgagctgaatattttgcacgccaccatgctcgccatgcagcgcgctgtcgctggtctgcatattgcgccagaatatgtgctgatcgacggcaatcgctgtccggagctgcctgtgccgtcaatggccgtggtgaaaggcgacagccgcgtggcggagattagcgcggcgtctattctggcgaaagtcacccgcgacgcagaaatggcggcgctggatatcgtttttcctcagtatggctttgcgcagcacaaaggctatccaaccgcttttcatctggaaaagttggcccagtatggcgcgacggcgcaccaccgacgcagttttgcgcctgttaaacgcgctctgggacttgtgtcctgattcttgtatcgagaaatctgaagatgtctgaaccacgtttcgttcacctgcgggtgcacagcgactactctatgatcgatgggctggcgaagaccgggccgctggtgaaaaaggcggcctcattaggtatgcctgcgctggcgatcaccgattttaccaacctctgcggtctggtgaagttctacggagcgggtcatggcgcgggcattaaacccatcgtcggggcggactttaacgttcacaacgaactgctgggagatgagctgactcatctgacggtactggcggcgaataatacgggataccagaacttgacgttgctgatctcgaaagcgtatcagcgcggctacggcgcggcaggcccgattatcgagcgcgactggctggtagagcttaaagaaggtttgatcctgctttccggcgggcgcatgggcgacgtaggccgctgtctgctacgcggcaaccaggcgctggtggaggagtgcgttgctttctatgaagcgcattttcccgatcgctacttcctggaactgatccgtaccggcagacaggatgaagagacctatctccatgctgcggttgagctggctgaggcacgtggtttgccggttgtcgcgacaaacgatgtccgttttcttgaaagcgatgattttgacgcccatgagattcgtgtcgcgatccacgacggtttcacgctcgacgatcctaaacgtccacgcaattattcaccgcagcagtatatgcgcagtgaagaagaaatgtgcgagctgttctccgatattccggaggcgctggaaaatacggtggagattgccaaacgctgcaacgtaacggtgcgtctgggtgaatatttcttgccgcagttcccgaccggcgatatgaccaccgaagattatctggtcaaaaaagcgaaagaggggctggaagagcgtctggctttcctgtttccggacgaagaagagcgcaaaaagcgtcgcccggaatatgacgagcgtctggatattgaactacaggttatcaaccagatggggttccctggctacttcctcatcgtgatggagtttatccagtggtcaaaagataacggcgtgccggtagggccgggacgtggttccggggctggttcgctggtggcctacgcgctgaaaattaccgaccttgatccgctggaatttgacctgctgttcgaacgtttcctgaacccggaacgtgtctcgatgcctgacttcgacgttgacttctgtatggagaaacgcgaccaggtgattgaacacgtcgcagatatgtacgggcgtgatgcggtatcgcaaattatcaccttcggtacgatggcggcgaaagccgttatccgcgatgtgggccgcgtgctggggcatccgtacggttttgtcgatcgtatctcgaagctggtgccgcccgatccgggcatgacgctggcaaaagcctttgaagcggaaccgcaactgccggaaatttacgaggcggatgaagaggtcagagcgctgatcgatatggcgcgtaagctcgaaggcgtcacgcgtaacgccggtaagcacgctggcggcgtggtcatcgcgccgaccaaaattaccgactttgcgccgctgtactgcgatgaagagggcaagcatccggttacccagtttgataaaagcgacgtggaatatgccgggctggtgaagttcgacttcctcggtttgcgtacgctgactatcatcaactgggcgctggagatgatcaacaagcggcgggcgaagaatggcgagccaccgctggatatcgctgccattccgctggacgataaaaaaagcttcgacatgctgcagcgctcggaaaccacggcggtcttccagcttgaatcgcgcggcatgaaagatctgatcaaacgtctgcagccggactgctttgaagatatgatcgcgctggtggccctgttccgtcccggcccgttgcagtcagggatggtagataacttcatcgaccgtaagcacggtcgtgaagaactctcttacccggacgttcagtggcagcatgaaagcctgaagccggtactggagccgacctacggcatcattctgtatcaggaacaggtgatgcagattgcccaggtactttccgggtatactctcggcggcgcggatatgctgcgtcgtgcgatgggtaagaaaaagccggaggagatggccaaacagcgttccgtttttgaagaaggcgcgaaaaagaacggtatcgacggcgaactggcgatgaaaatctttgacctggtggagaaattcgccggttacgggtttaacaaatcgcactccgccgcttatgcgctggtttcttaccagacgctatggctaaaggcgcactatccggcagagtttatggcggcggtgatgactgccgatatggacaacaccgagaaggtcgtcggcctggtggacgagtgctggcggatgggactgaaaattctgccgccggatattaactccgggttgtaccatttccacgttaatgatgagggcgagatcgtctacggtattggcgcgatcaaaggcgtcggcgaaggtccgatcgaagcgatcatcgacgcgcgtaatcagggcggctatttccgcgagctgtttgatctgtgcgcgcggaccgacaccaaaaagctcaaccgccgggtgctggaaaagctgatcatgtccggggcgttcgaccgcctggggccgcaccgcgccgcgctgatgaactcattgggcgatgcgctgaaagccgccgaccagcacgccaaagcggaagctatcggtcagacggatatgttcggcgtgctggcggaagagccggagcaaatcgaacaatcctatgccagctgccagccgtggccggagcaggtggtgttagatggggaacgtgaaacgttggggctgtacctgacgggccaccctatcaatcagtatttaaaagaaattgagcgctatgtcggcggggtaaggctcaaagacatgcatccgacagaacgtggtaaagtcaccacggctgcggggctcgtgattgccgcaagggttatggtcaccaagcgcggcaatcgtatcggcatctgtacgctggatgaccgttccgggcgtctggaagtgatgttatttaccgacgcgctggataaataccagcagttgctggaaaaagaccgcatacttatcgtcagcggacaggtcagctttgatgacttcagcggggggcttaaaatgaccgcccgcgaagtgatggatattgacgaagctcgcgaaaaatacgctcgcgggcttgctatctcgctgacggacaggcaaattgatgaccagcttttaaaccgactccgtcagtctctggaaccccaccgctcggggaccattccagtacatctctactatcagagggcggatgcgcgtgcgcggctgcgttttggcgcaacgtggcgtgtctctccgagcgatcgtttacttaacgatctgcgtggcctcattggttcggagcaggtggaactggagtttgactaatacaggaatactatgagtctgaatttccttgattttgaacagccgatagcagagctggaagcgaaaatcgattctctgactgcggtaagccgccaggatgagaaactggatattaatatcgatgaagaagtccatcgcctgcgcgaaaaaagcgtagaactgacgcgcaaaatcttcgccgatctcggcgcatggcaggtagcccaactggcgcgccatccgcagcgtccgtacaccctggattatgtccgtctggcgtttgatgagtttgatgagctggcgggcgatcgcgcctatgctgatgacaaagccatcgtcggcggtatcgcgcgtctggaagggcgaccggtgatgatcattggtcatcagaaaggtcgtgaaaccaaagaaaaaattcgtcgtaactttggcatgccagcgccggaaggctaccgcaaagcgctgcgcctgatggaaatggctgaacgcttcaacatgccgattatcaccttcatcgacaccccgggtgcataccctggcgtgggcgcggaagagcgtggtcagtctgaagccatcgcccgcaacctgcgtgagatgtctcgtctgaacgtaccggtcatctgcaccgtgattggcgaaggcggctccggcggcgcattggcgattggcgtgggtgataaagtgaatatgctgcaatacagcacctattccgttatctccccggaaggttgcgcctctattttgtggaagagcgccgacaaagcaccattggctgctgaagcgatgggcatcatcgcgccgcgtctgaaagagctgaagctaatcgattccatcattccggagccgctgggcggcgcgcaccgtaatccggaagcgatggcggcatcgctaaaagcgcagctgctggaagatttagccgatctcgatgtgttaagcaccgatgatttaaaaaaccgtcgttaccagcgtttgatgagctacggttacgcctaatcatttacctcatttttccccaagaggccggataatccggcctcttttttttggtcgaggaaaaatgagacgccgatgagttgatgtgattaaacgcaacggcatgttctccctgacactgtatcaactgccaggcgtgtggccagggcaggcagtgaactacccttcaaggagaaaattatgggattgcaaaaaacactggcgctcagcgccgtagcggcagggatcatgttgagcttatccggtgcgcaggccgcgccgctgcttagcagtagtgagccaatgaccattaacgccagcgatctggcggcgaaagagaaagcgctaacggattttccgttaatggaggccgtgaaatcctctattcagacgttggataacagcgcggtcgaacaaatcgaaccggggcgcgccgctaacccggcaaacgtaaaacgcgttgaaagtattctgaaagaggccgactgggattatctgttcccgatgcgcgcgccggaatatacttactctaacttcctgaaagcgataggtaaattcccggcggtttgtggtacctacaccgatggacgcgatagcgacgctatctgccgtaaaaccctggctactatgtttgcgcattttgcccaggagacgggcggtcacgaaagctggcgtgacattccggaatggcgtcaggcgctggtctatctgcgcgaagtcggctggacagaagggcagaaaggcggctacaacggcgaatgtaacccggatgtatggcagggccagacctggccgtgcggtaaagataaggacggcgatttcctcagctattttggccgcggggcaaaacagctttcttataactacaactatgggcctttctctgacgcgatgtatggcgacgttcgccctctgctggataaacccgagctggtggcggatacctggatgaacctggcgagcgccgtcttcttctttgtgtatccgcagccgccgaagccgtctatgctacatgtgattgacggtacctggcagccaaacgatcgcgataaagcaaacggcctggtatcaggtttcggcgtcactattcagatcatcaatggcggcgtggagtgcggcggcgcagatgagaatgcgcagtcgcttaaccgcatcgcctactacaaagagtttgccaactacctgaaagtgccggtgccggcggacgaagtgttgggctgtaaaaagatgaagcagttcgatgaaggcggcgctggcgcgttaccgatctattgggaacaagactggggctggagcgccgatactgcggacggtaaaacctattcctgccagttagtgggatatcagacgccgtataccgcctttaaagagggcgactacacgaaatgtgtacagcattatttcaacgttaatgtcgtcgatgataacggaaccactgaaccggatgtcacgccaactccggcgccagtgacggatgaaaacgtggcgccagtcgcgcgcattgccggaccggtcggggcggtggaagccggtagcccggtttcactcagcgcggaaggatcgaccgacgcgaatggcgacaagctcacctatacctggatgtcgcaggatggcaaaacgctgagcggccaggataaagccgttgtgattttcaacgcgccggatgtcactcagaacacccagtatgtggtgaatctgaccgttagcgacggtacgctctccagtacagcggtttatacgctgaatgtgaaagcgaaggccgccgctgcggatgacgaagataagaccaccagctaccctgcctggagcagcagccagaaatggaatccgggcgacatcgtcaacagtaatggcgcattgtaccagtgcaaaccgttcccggaaggctcatggtgtaatgttgcgcctgcctactatgagcccggcgtagggattgcctgggccgatgcatggaacgcattgtaataagataaatcctgtcggtgctttgcatcggcaggattgttactatgcttatctcaggttttttcaggagaaagcatgaacatcatcgccattatggggccgcacggggtttattataaagatgaacccatcaaggagcttgagcgtgcattacaatccctgggatttcaaattatctggccgcaaaatagcgttgacttgttgaagtttattgaacataacccgcgcatctgcggcgttatttttgactgggatgaatacagtctcgacctttgtagcgaaatcaaccagctaaatgaataccttcctctctacgcctttatcaataccaactccacgctggacgttagcgttcacgatatgcgcatggcgctgtggttttttgagtatgcattggggctggctgaagatatcgcgacgcgcattcatcaatatacaaacgaatatctcgataatattacgccgccgtttaccaaagcgctttttacctacgccaaagaaggaaaatataccttttgtacgccgggtcatatggcgggaacggcgtatcagaaaagcccgccaggctgcctgttttatgacttttttggcggcaataccttaaaagctgatgtgtcgatttcggtgactgaactgggatcgctgctggatcacaccgggccgcatctggaagcggaagagtatatcgcccgtacttttggcgccgagcagagctatatggtgacgaacggtacgtcgacctcgaataaaattgtcggtatgtatgccgcgcctgcgggaagtacgctacttattgatcgtaattgtcataaatcgctggcgcatttgctgatgatgagcgatgtggtgcctctctggttgaagccgacgcgcaatgcgctcggcattctcggcggtattccccgaagggaatttacccgtgcaagcatcgaaagcaagatagaggagacccctcaggcgcaatggccggtgcatgcggttatcaccaattcgacttacgatggtctgctgtataacactaactggatcaagcaaatgctggacgttccctcgatccattttgattccgcctgggtaccctatacccatttccatccgatctaccaggggaaaagcgggatgagcggcgatcgggtgcccggaaaagtgattttcgaaacgcaatccacccataaaatgctggcggctttttcgcaggcgtcgcttattcatatcaaaggggaatatgacgaagagacgtttaacgaagcgtttatgatgcacacttccacatcgccgagctatcccattgtcgcctctatcgagaccgcagcggcgatgctgcgcggcaatccagggaaaagattgattaatcgttcggtggaacgggcgctccattttcgtaaagaggtacagcggctacgtgaagagtccgatagctggttctttgatatctggcagccggaagaggttgatgaggccgaatgctggccggtcacgccgggagaaacctggcatggcttcaccgatgccgatgacgatcatatgttcctcgatccggttaaggtgacaatcctgacgccggggatggatgaacagggcaacatgagcgaagaggggatacccgccgcgctggtggcgaagttccttgatgagcgaggcgtggtggtggaaaaaaccgggccgtataatctgctgtttttgttcagcatagggattgataagacccgtgcgatggggctgctgcgcggactgacggaatttaaacgcgcctacgatcttaacctgcgcgtcaaaaatatgttgccggatctgtatgcggaagatccggatttttatcgcaatatgcgcattcaggatctggcgcaggggatccataaactgatccgccagcacgatcttccggggctgatgctgcgggcgttcgaggttttaccggagatgatcatgaccccgcaccaggcctggcagcgtcagatcaaaggtgaggtggaaaccgtggcgctcgatcaactgccagggcgcgtttccgcgaatatgatcctgccttatccgccaggcgttccgctgttgatgcccggcgagaggatcacgcaacagagtcgggccgtgctcgattttctgctgatgctctgctcgattggccagcattatcccggttttgaaacggatattcacggcgcgaaacggaatgaagacggggtgtaccaggtacgagtcttaaaacacgcctgctagcttgcctgacgggaatgtgacgagtaacgtactgataatcaataaaggagacgctatgctgggattaaaacaggttcatcacatcgcgatcattgcgacagactatgcggtgagcaaggcgttttattgcgatattctggggttcgatctgctaagcgaagtctggcgggaagagcgtgactcgtggaagggcgatttggcgctaaacgggcagtatgtgattgagcttttctcttttcccttccctccggcgcgtccaagccgacctgaagcctgcggcctgcgccatctggctttcagcgtggaaaatgtggaaaacgccgttgcgcatctggaaaagcatcaggttaagtgcgaaccgatacgcatcgatccgtataccgggaagcgctttacttttttcaacgatccggacggtttaccgcttgagctgtatgagcagtaaggcttgtcattaagacgctcgccaggtaacgttgccgggctaagtcactataagcatggatcatgaccactctcacgttgaatacctcgttactctcttctcgccgtattctggctgcctttagcggcggcctggattctacggtgctgttgcatcaactggtgttgtggcgagaacgccatcctgacgtcacgctgcgtgctatccatattcatcacggtttaagccctcatgctgatagctgggtgcggcattgcgaaaccgtatgcgaacgctggcaggttccgctggtagtggagcgggtgacgctggcggataatggcctgggtatcgaggcccatgcgcgtgaagcgcgctaccgggcgttcgcacagacgctattgcctggcgaagtgctggcaaccgcgcagcaccttgacgatcagtgtgaaacgtttctgctggcgttaaagcgcggcagcggtccggccggactttccgcgatgggagaacgctcgccttttgccggaactctgcttcttcgcccgctgttgagagaaacgcggaagacgctggaacagtgggctgtgcgtcatggcttatgctggattgaagatgaaagcaatcaggatgacgcctacgatcgcaattttttacgcctgcgcgcgcttccgctcttacagcagcgctggccgcattttcctgcggcggtagcccgtagtgcgacgctctgcgccgagcaagaaaggctgctggacgagcttctggccagcgatcttactgactgtatcacggcggagggaacattgcggctctctccattaatgtcgatgagcgatgtacggcgggcggcgattttgcgtcgctggctggcgatgcgtaatgcgccgatgccctctcgcgacgcgctggaacgtatctggcaggaggtggcgctggcgcgcgacgatgcctctccctgtttacgctttggcgatcacgagattcgccgttaccagtcgcaactgtggtggattaaatccgtggccggacaacacgaaacgacggtcgcctggcccgtctggcaaacaccgctggcgctgcctgccggcttagggacggtacagctcgttcctggtggcgaactgcgccgaccgcgagaggaagaatccgtcagcattcgttttaaagcgccaggcgtgttacatattgtcgggcgtaacggtggacgtaaattaaagaaaatctggcaggagcaggggatcccgccctggcgacgagataccacgccgctgttgttttacggcgaaacgctgattgcggctgcgggtgtttttgtgacgcgtgagggagcagcagaagataaagaaggggtgagtctggtttggcatgcctgatggcgctgcgcttatcaggcctacgtatcgcatggaacgtaggccggataaggtgcttgcaccaccatccggcaacaaaatactcaggattcgctaactaccacggtaccaatttccgggtggctgaaactggcgattttatcgagacgaagttcacaagactcgccggaaacttcggcaagcagatattctacgtttttacgtaagatcaaatcgttcgcttttgcctgcaaaacctcgccatcttttaacgttagcgtcagtattaaatgatgcatgcaggcaagctcaagactatcgtagtcatcgcaattaatgggttgatacgtttcattcattgacataatcgctcaccagtaagttcgcggcagcataagctgccttttccctgaccgactctgaaagggcgctatctgccgccacttcattaagcactttcaatacacaacccagcgcatccgggacataccctaagtctccgctggcgatttccgcataccgcttgcgtactaactcacaatatttttccacatgccctcctgtcagcattctgacttaaccgtggatgcaagtctaagcctacgaagttaaatcttgtttagcaaggtgactataccatactcatttgcgcaatatcagcgcctgacgcgagtgggtaaaagattcgttaacagccttttagcgcggttttcgctacaatgggcgcctgattcgaaaggagttttctcatggcgcttaaagcgacaatttataaagccgtcgtcaatgtggctgaccttgatcgcaaccggtttctggatgcggcattgacgctggcgcgtcacccttctgaaacgcaggagcgcatgatgctgcgcctgttggcatggataaaatatgctgatgaacggttgcagtttacacgtgggctcagcgcggaagatgagccggaggcctggctgcgcaacgatcatctgggcatcgatctctggatagagctggggctgccggatgagcgccgtattaagaaagcctgtactcaggcgagcgatgtcgcgctctttgcttataactcccgggcggcgcaaatctggtggcagcagcatcaaagcaagtgcgcgcagttcgctaacctgtccgtctggtatctggatgacgggcagctggcgcagctcagtgaatttgccgatcgtaccatgacgctacaggcgacgattcaggacggcgcaatctggctttctgatgctcggaataatctggaaatacagctaaccgcctggcaacagccctcatgattgccatctcccggacggtctccatagccgataatgagctggaaattacggccattcgtgcgcagggcgcgggtggtcagcacgtaaataagacctctagcgcgattcatttgcgctttgacattcgggcctctggcctgccagagtattataaacagcgtttgctgacggccagccaccatctgataagcgatgatggcgtcattatcattaaggcgcaggagttccggagccaggagctcaaccgggaagcggctatcgccaggctggttgccgtcataaaagaattaaccgcggagcagaaaagccgtcgcgcaacccgtccgacgcgtgcctcgaaagagcgccgtttgtcctcaaaggcgcaaaaatcttctgtaaaggcgcttcgcggcaaagttcgtcgtccactggattgacgggcaggaatagcaatttcataaggattttatggtgagaacagcaatattgtcagtagcggcagcctgtacgctatttgcattgatagggtgtaataaccgtgcggaagttgacgccctgcaacctgcgcaggcggcggaattaaaacccatgcagcaaagctggcgcggcgtgctgccctgtgcggattgtgaaggtattgaaacgtcactatttctggaaaaagacggcacatgggtgatgaacgagcgctatcagggcgtgcgcgaagaaccttcctcttttgcgtcatacggtacctgggcgcggacggcggataaactggtgttaaccgacagcaatggcgagaaatcgtattatcgcgcgaagggcaatgcgctggagatgctcgacagagaaggcaatccggtggcttcgcagcttaattatacgctggtgcctgttaccgccagcctgccggtaacgccaatgccgctgcgtggtatgtatgtatgtatacagggccgatgcggcgacctttaccgattgcgcgaccggaaaacggctgccggtcgccagtaacgcccagcttgagcgcggctatctggcggcgaaaggtgaagcggaaaaaccggtgctgctgacggtagaagggcattttgtgtttgccgcgaacccggacacgggcgagccggtaaaaacgctaatagccgataaaaatgcgaagtttgcgccgggtaaagattgcactcactaataaaaggcctcgcagggtgcgaggcctttacatatctgccggatggcgccgggcaaccccaacaaaatgtcgtttagcccttaatcgccttgaccagataatcaacgatatcgccggttttaatcagcgatttttcaccgctacgacggtatttatactcaatatcgtcgttatccaggttgcgatcgccaatcacgatagtatgtggaataccaatcagctccatatcggcaaacatcacgcccgggcgctctttacggtcgtccatcagcacttcaatgccctgcgcgcgcaattcgctgtacagcttttccgccagctcctgcacacggaaggatttgtgcatattcatcggcagaatagcgacctggaaaggcgcaatggcgtcaggccatacaatgccgcgctcgtcaaagttctgctcgatagcagcggcaacgacacgtgttacgccgataccgtagcagcccattgtcaggatctggttacggccatcttcaccctgaacggaggctttcagcgcttctgagtacttggtacctaactggaagatgtgacccacttcgataccgcgtttgataagcaacgttccctgaccatccggactcggatcgccggcgactacgttacggatgtcggcaacaacaggcgtcgccacatcgcgatcccagttaataccaaagtagtgtttaccgtcgatgttggcgccagcggcaaaatcgctcatggcggcaacggtacgatcgatgatgaccggaatcggcatattgaccgggccgagggagccagggccggcattaattacggcgcgaatctcttcttcggtagcgaaggtcagcgggctggcaacgtgcggcagtttttccgctttaacttcattcagttcatgatcgccgcgaaccagcagagccaccagcggagacttgctgtctttcaccgctttcaccagcagcgtttttaccgttttttcaattggcaggttgaattgttccaccagctccgcgatggttttggcatttggcgtatcgaccagagtcatttcctgcgtcgccgctgcgcgcggcgtttgcggcgcgatagcttctgccagttcaatgttagccgcgtaatcagaaacatcagagaaaacgatatcgtcttcgccgctttgcgccagcacctggaattcatgcgaggcgttgccgccgatagaaccggtatcggcctgtaccgcgcggaaatccagccccatacggctgaagatacggctatacgcggcgtacatggcgtcataggtttcctgcaacgactcctgagaggtgtggaaagagtaagcatctttcatcaggaattcgcgcgaacgcatcacgccaaagcgcggacgcacttcatcacggaatttggtctggatttggaagaagttcagcggcaactgcttataagagctgagttcattacgcaccaggtcggtgataacttcttcgtgggtcgggccgagtacgaacggacgctcgccacggtcgacaaaacgcagcagttccggaccgtactgttcccaacgaccactctcttgccacaggtcggctggctgaacgactggcatcgacacctcgatagcaccggcgttgttcatctcttcacgcacgatgttttcgacttttttcaggacgcgcaggccggtcggcagccaggtatataacccggaggcgagcttgcggatcatcccggcgcgcagcatcagctggtggctgataacctcggcgtcggcaggtgtctccttcagagtggagagcaggtattggctagtacgcatgttgttacggttccagttgaacgatcgaacaggctcaatgtgagcctgatacaaaaaaagtgatttagtttaccagcgtgcaagagatgtcaaaagagaagggcgtgaaattaccgtggttccagcgcaaacacttcaaatcccgagttaaccacacgccagcgcacgttaaaatcatgcagccagacggcataggttttgcccgtctcttcacccttacgataagccgggcgaggatcttgcgccagcacatcgcaaataaatgtccgtagctgcggataacgcctttccagcgtcgtaagctgttgagccacctcagcggtaaaactcacgggcatttcagctatcggcgcctgttgcgcatagctggcggcggcgtccggtaaggcctcggcaaacggtaaatacggtttaatatccaccaccggcgtgccatccaccagatccagactgcctaatttcagaattacgctctctttccggcactcgataccttttagcgcaacgagcgacatgccaatcggattggggcggaacgtggagcgcgtggcaaaaacgcccattctggcgttaccgccaagacggggcggacgaactgtcggccgccagccgccgtccatcgtctgatgaaaaacgaaaagcacccacaaatggctgaacgcttccaggccgcgaacggcatcggcctggttgtaaggcgctatcagatgcagttcgccgcaggcgcttttgaccagaccaggctggcgcggaacggcgaatttttctttatagggggagcgaataacgccgatttgttcaaactgaaagctgctcatttcgccgaaatattcagggcggacccgatacaaaccgcctgacgatagcagcctggcgtgccgctggtaatttcacagctgtgcagcaggacggcgttggctttcattttagatgcattaatctgcatacgcttgcgcgcagttggaatgttaggcggagagtcttgatttgtcgcctggcaggattcgccgctaacctcgccaagatctcggaaaggtttgccgactaagtcttcagcattggtgtaaatcctgacgggagcggcacgcggcgctttaggtttctccggctccgcttttggcggggttgcggtgctttgaacgggttcaacaggggatctgcttagcatggaacaaccgcccagcatgagtgccaataaacagatcggtaaagcacgcataatatttcctcaatgaatgttctaattgccagatattgaatcaggagcttgcataaatgacaagacgggcaatagcccgtcctgaataatattacagattgtggaatcagcctaaaacttaccagcctttcaccgcgccgccattaaaaactttatttgcggcttcgtacacttcatcagactgataagcctgaacgaattttttcacattctcggcgtctttgttatcttcacgcgtcacgatcaggttaacgtacggagaatctttatcttcaacaaagataccgtctttcgctggcgtcaggccaatctggctggcgtatgtcgtattgatgaccgctagcgcgatctgcgcgtcatccagcgaacgcggcaactgcggcgcttccagctcaacaattttcagatttttcgggttttccacgatatccagcgaggtaggaagcagaccgacgccgtctttcagtttaatcagccctactttttgcagcagcagcagggaacgaccaaggttggtcgggtcgttaggcacagcgacctgggaaccgtccttgagctcatccagggatttgatttttttggaatatcctgcaatgggatagacaaaagtcttaccaacggaaaccagtttgtaaccgcgatctttgatttgctgatccagatacggtttgtgctggaaggcattggcatcgatatcgcctttgctcagcgcttcattaggcagaacataatcattaaaggtcaccaattccacgtccaggccgtatttttctttcgcgactttctgcgcgacttcggcaacttgctgctctgcgccaacgattacgccgactttaatatgatttggatctttttcatcctgaccgcaacccgcaagtgccagagaaccaatcagagcacccactgccgcaaaggttttgaatttgaacgccatgcttatttccttaatgagtatttgtgttgtgtttaacgttacttatgcgtgacagccctgacgatgcgatcgccggataactgaattaaataaaccagaacgacaagtaataccagcaccgtattcatcacggtagcattgtatccaatataaccgtactgatagccgatttgaccgagaccgcctgcgccgacggcgccgcccattgcggagtaaccgaccagggtgatcagtgtaatggttgccgcattcaccagaccaggcagcgcttccggtaaaaggattttacgtacaatttgcagcggcgtggcgcccatcgctcgtgaggcttcaatcagcccggcagggatctctaacaacgcattttccaccatacgggcgataaaaggcgcggcgccgacggtcagcggtacaattgcagcctgcaaaccaatggaggtgccgacaattattcgggtaaaaggaatcatccacaccagcaggatgataaagggaatcgagcggaaaatattgaccaccgcagagagggagcgatacagcctggcgttctccataatctgccccgggcgcgtaacatacagcaatacgccaaccggcaggccaatcacgaaaccgaagaaaccggagacaaaggtcatcgccagcgtttcccagacgccacgaaccagtaaccacatcattgcctcagacataacccagtacctctactttcacatggtgatcctgcagccaggcaattgcggcttgcgtctcttcttgcgtgccgtgcatttccgttagcataatgccgaacttcacaccgccggcgtaatccatctgcgcgctgataatattattgttcacgttgaaacgacgcgcggtttcagaaagcagcggggcatccacagactgcccggtgaattccatgcgcagcatcggcacgctgtcagtttccggcgacgctttcaaacgcgcctggtaatcttccggaatgtccagatgcagagtggactgaataaacttctgcgccagcggcgttttaggatgcgagaagacttcgctgaccgtatcctgctcaataagctcgccattactgataacggcaacgcagtcgcagatacgtttcacgacatccatttcatgagtgataagcagaatcgtcaaccccagacgacggttgatatctttcagcaattccaaaatcgaacgggtcgttgcgggatcaagcgcgctggtggcttcatcgcacagcaacacttttggattactggctaacgcgcgggcaatcgcgacacgctgtttctgaccgccggaaagatttgccggatagctgtcgtgcttgtcgccaagaccgactaaatccagcagctctgtgacacggcgtttgatctcttcctttggtgtgttatccagttccagcggcaacgcgacgttgccaaacacggtacgggaagagagcaggttaaaatgttggaaaatcatgccgatttgacggcgagctttggtcaactcagactctgaaagcgttgttagctcctgaccgccgacctgaacgctaccttcggttgggcgttcaagtaagttaacgcagcggataagcgtacttttaccggcgccggaggcgccaatgacgccataaatctgcccggcaggaacgtgcaggctgacattatttagcgcctgaatggtgcgcgtcccctgctggaacactttggtaatattcgaaagtttaatcattgattctttattatcgtaatgaaatgagcggaggcattttcgtctgcctaatacggtcaacgccgtcaacagaatggatgttaaggcatccagacgtctaaatcaatcaggctttatacgatgagcactttcttgcctgctgaaacatgcgatactagcgccacttgctttactcaggagctataaaaggtggcaaagtttgtacccgcaatttttctcgaccgtgacggcaccattaatgtggatcacggctacgtacatgaaatcgatgcatttgagtttatagacggcgttattgacgctatgcgcgagctaaaaaaaatgggctatgcgttggtggtggtgacgaaccagtccggaatcgcgcgcggcaaattcactgaggcgcagtttgaaacgttaaccgaatggatggactggtcgttggcggatcgcgatgttgatttggacggcatctattattgtcctcaccatccgcagggcagtatagaagagttccgtcaggtatgtgattgccgcaagccgcatccaggaatgcttatctcggcgcgtgatttcctgcatatcgatatggcggcttcttatatggtgggagacaagctggaagatatgcaggcggcagcggcggcaaatgtcgggacaaaagtgctggtgcgtacgggcaaaccggtcacggcagaagcagaaaacgcggcggactgggtgttaaacagccttgctgacctgccatcagcgataaaaaagcagcaaaaataagcgttatggataaaagatgagcggttaaaacaaaaatgcatttttccgcttgtcttcctgaaccgactccctataatgcgcctccatcgacacggcggatgtgaatcacttcacacaaacagccggtcggttgaagagaaaaatcctgaaattcagggttgactctgaaagaggaaagcgtaatatacgccacctcgcaacggtgagcgaaagccgcgttgcactgctctttaacaatttatcagacaatctgtgtgggcactcgaagatacggattcttaacgtcctaggacgaaaaatgaataccaagtctcaagagtgaacacgtaattcattacgaagtttaattcattgagcatcaaacttttaaattgaagagtttgatcatggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtggctaataccgcataacgtcgcaagaccaaagagggggaccttcgggcctcttgccatcagatgtgcccagatgggattagcttgttggtgaggtaacggctcaccaaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgtggttaataaccgcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtctacttggaggttgtgcccttgaggcgtggcttccggagctaacgcgttaagtagaccgcctggggagtacggccgcaaggttaaaactcaaatgaattgacgggggcccgcacaagcggtggagcatgtggtttaattcgatgcaacgcgaagaaccttacctggtcttgacatccacagaactttccagagatggattggtgccttcgggaactgtgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgaccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaacaaggtaaccgtaggggaacctgcggttggatcacctccttaccttaaagaagcgtactttgcagtgctcacacagattgtctgatgaaaaacgagcagtaaaacctctacaggcttgtagctcaggtggttagagcgcacccctgataagggtgaggtcggtggttcaagtccactcaggcctaccagattcgctcccgtgctttgttgtggcaaagctcgcatacttcagtatgcttcgcttcaccacgccgcgcccggaaacgaatcaaaggtaagaggttctgactacacgatggggctatagctcagctgggagagcgcctgctttgcacgcaggaggtctgcggttcgatcccgcatagctccaccatctcgtgagtgtttacgaaaaaatacttcagagtgtacctgaaagggttcactgcgaagttttgctctttaaaaatctggatcaagctgaaaattgaaacacagaacaacgaaagttgttcgtgagtctctcaaattttcgcaacacgatgatgaatcgtaagaaacatcttcgggttgtgaggttaagcgactaagcgtacacggtggatgccctggcagtcagaggcgatgaagggcgtgctaatctgcgataagcgccggtaaggtgatatgaaccgttataaccggcgatacccgaatggggaaacccagtgtgattcgtcacactatcattaactgaatccataggttaatgaggcgaaccgggggaactgaaacatctaagtaccccgaggaaaagaaatcaaccgagattcccccagtagcggcgagcgaacggggaggagcccagagcctgaatcagcatgtgtgttagtggaagcgtctggaaaggcgcgcgatacagggtgacagccccgtacacaaaagcgcatgtgctgtgagctcgatgagtagggcgggacacgtggtatcctgtctgaatatggggggaccatcctccaaggctaaatactcctgactgaccgatagtgaaccagtaccgtgagggaaaggcgaaaagaaccccggcgaggggagtgaaaaagaacctgaaaccgtgtacgtacaagcagtgggagccccaccactaagccagtggtgaactccacatccgcatcctttgctgaggatacggttaacggagcgaaagcgacgttcaaccgcaaaacaagcagagggggcttagtggtggggtgactgcgtaccttttgtataatgggtcagcgacttatattctgtagcaaggttaaccgaataggggagccggagggaaaccgagtcttaattgggcgttaagttgcagggtatagacccgaaacccggtgatctagccatgggcaggttgaaggttgggtaacactaactggaggaccgaaccgactaatgttgaaaaattagcggatgacctgtggctgggggtgaaaggccaatcaaaccgggagatagctggttctccccgaaagctatttaggtagcgcctcgtgaattcatctccgggggtagagcactgtttcggctagggggccatcccggcttaccaacccgatgcaaactgcgaataccggagaatgttatcacgggagacacacggcgggtgctaacgtccgtcgtgaagagggaaacaacccagaccgccagctaaggtcccaaagtcatggttaagtgggaaacgatgtgggaaggcccagacagccaggatgttggcttagaagcagccatcatttaaagaaagcgtaatagctcactggtcgagtcggcctgcgcggaagatgtaacggggctaaaccatgcaccgaagctgcggcagcgaacgtatcacccaagacaactttacggagttgacgattgacggagcgaagcgacgtcaaagcgttcattaaagtcgagttggcttagggatacgttcgttgggtaggggagcgttctgtaagcctgtgaaggtgtgtcgtgaggcatgctggaggtatcagaagtgcgaatgctgacataagtaacgataaagcgggtgaaaagcccgctcgccggaagaccaagggttcctgtccaacgttaatcggggcagggtgagtcgacccctaaggcgaggccgaaaggcgtagtcgatgggaaacgggttaatattcccgtacttggtgttactgcgaaggggggacggagaaggctatgttggccgggcgacggttgtcccggtttaagcgtgtaggtgtgtgttccaggtaaatccggttcactttaacactgaggcgtgacgacgaggcactacggtgctgaagcaacaaatgccctgcttccaggaaaagcctctaagcatcaggtaacacgaaatcgtaccccaaaccgacacaggtggtcaggtagagaataccaaggcgcttgagagaactcgggtgaaggaactaggcaaaatggtgccgtaacttcgggagaaggcacgctgacacgtaggtgaagtgatttactcatggagctgaagtcagtcgaagataccagctggctgcaactgtttattaaaaacacagcactgtgcaaacacgaaagtggacgtatacggtgtgacgcctgcccggtgccggaaggttaattgatggggtcagcgcaagcgaagctcctgatcgaagccccggtaaacggcggccgtaactataacggtcctaaggtagcgaaattccttgtcgggtaagttccgacctgcacgaatggcgtaatgatggccaggctgtctccacccgagactcagtgaaattgaactcgctgtgaagatgcagtgtacccgcggcaagacggaaagaccccgtgaacctttactatagcttgacactgaacattgagccttgatgtgtaggataggtgggaggctttgaagtgtggacgccagtctgcatggagccgaccttgaaataccaccctttaatgtttgatgttctaacgtggacccgtaatccgggttgcggacagtgtctggtgggtagtttgactggggcggtctcctcctaaagagtaacggaggagcacgaaggttggctaatcctggtcggacatcaggaggttagtgcaatggcataagccagcttgactgcgagcgtgacggcgcgagcaggtgcgaaagcaggtcatagtgatccggtggttctgaatggaagggccatcgctcaacggataaaaggtactccggggataacaggctgataccgcccaagagttcatatcgacggcggtgtttggcacctcgatgtcggctcatcacatcctggggctgaagtaggtcccaagggtatggctgttcgccatttaaagtggtacgcgagctgggtttagaacgtcgtgagacagttcggtccctatctgccgtgggcgctggagaactgaggggggctgctcctagtacgagaggaccggagtggacgcatcactggtgttcgggttgtcatgccaatggcactgcccggtagctaaatgcggaagagataagtgctgaaagcatctaagcacgaaacttgccccgagatgagttctccctgagacttagagtctcctgaaggaacgttgaagacgacgacgttgataggccgggtgtgtaagcgcagcgatgcgttgagctaaccggtactaatgaaccgtgaggcttaaccttacaacgccgaagatgttttggcggattgagaagacaacaattttcagctcagattcagagtccgaaggattttacgctgagacaaggcggcaaacgcagcgacggaaggagcatacagaagtatgtgactgacgctcgcaagagcagccaacgccgtatcagtgtaaaagacacaggacggagcacaaagaatttgcctggcggcactagcgcggtggtcccacctgaccccatgccgaactcagaagtgaaacgccgtagcgccgatggtagtgtggggtctccccatgcgagagtagggaactgccaggcatcaaattagaagtatggcattaactttcggggcagttcactactcgacagagagtaggacaaaagcgaaagcttttgaacgttgcgaagcaacggcccgaagggtgaatcacgaagtgattcataaactgccaggcatcaaattaagcagtaaactgatgtaaaaatcagtggttgtaaaagaattcggtggagcggtagttcagttggttagaatacctgcctgtcacgcagggggtcgcgggttcgagtcccgtccgttccgccacttattaagagccctgagcattagctcagggctttttctttccatgtcatttaattattgctcaattcgcaaaaatcctctgcatttctcgctctttttctgcaaagcgctgaaggtcataatcccctcagttaacgaacatagtgattaaaaagaggaattctatgactatccctgcattcggtttaggtacttttcgcctgaaagacgacgtggttatcgcttctgttaaaacggcgcttgaactgggctaccgtgctgtcgacactgcgcaaatctatgataatgaagcggctgttggacaggcgattgctgagagcggcgtaccgcgtaatgagctgtacatcaccaccaagatctggattgaaaaccttagcaaagacaagctaatcccaagcctgaaagagagtctgaaaaaactgcgtaccgattatgtcgatctgacgctgatccactggccatctccgggtgatgccgtgtctgtcgaagaatttatgcaggcattgcttgaagctaaaaaacaagggctgactcgcgaaattggcatttcaaacttcaccattccgttgatggaaaaggctattgccgcggtgggcgcagacaatatcgccaccaaccagattgagctatctccgtatctgcagaatcgtaaggtggttgactgggcgaaagcgcacggtatccacatcacctcttatatgacgctggcatacggtaaggcgctgaaagatgaagtgattgcgcgcattgcggctaaacataatgcgaccccggcgcaggttattctggcatgggcaatgggtgaaggttactccgtgatcccttcatccaccaggcgtgaaaatctggcaagcagcctgctggcgcaggatctgcatctggatgccgaagataaaaatgcgatcgcggcactggactgcaacgatcgtctggttagcccggaaggactggctcctgcctgggattaattacccgatcctttgtacctttacccctctttcacagctcctgcgggagctgttcttatatattcgctcaaaaagtcgataaatgcccgaatacgtgtgctgacggcgcgatcgctgtagtaaacggcgctgaaaggcatttctaccggcagacgtttatcggccagcagttccaccagttctccccgcgcgatctctttatcaatcatataatctgaaagacatgcaatgccgttaccgttcaggcaaagttgttttaacgtttccccgctattggaagaaatcccacatttgatctcatggagctgcccgtcgctacaggcaatcggccaggtattgagcgaaacaggttctgagaaccccagacacagatgccgtttcaactcttcaacggtctcaggcttgccaaagcgggcaatataatccggcgaggcgataatcttgcgatagctggtaaataacgggcgcgcgcgcagacttgaatctgtcaacgtgcctgcgcgtatcgcaacatccacttttcgttcaataagattgatgaacgtttctgaggagacaagagacaacgttatttccggataccgttcacgaaaaggtttaatcagcggcatcaggaaatgcagcattaccggcgttgccgcatcgatacgcagtaagccgcgcggggtattacgcgactccatgatttccgtttctgcggcggccatttcttgcagtatctgctgcacgcgcctgaagtatcgctctccttcttcagtcaggctcagctgtcgggtcgtacgattaagcagactgacgccgagcttcatctccagctttttaactgcccggctgacagcggaattggcctgtccaagctgctctgccgcccggctgaagctgccgctttccacgacagcgacaaaaattgcgagttcttcggaggtggctttcatttttgctcctgaagcaaaattaaattgatattttggctatttttgtcattaaaacatccaggcatactgcgtgtcatctgattactgctgttatggagttatgtatgcctctcgctttatttgcactgacaataagtgctttcgctatcggtacgactgagtttgtgattgtcggcctggtgccgaccattgctcaacaactggctatctcgttaccttccgccggaatgctggtttcaatctatgcgctgggtgtggctattggcgcgccggtgctaaccgcgctgaccggacgcctgccgcgtaaacagttactggtcgcgctgatggtcttgtttacggcggggaatttgctggcatggcaggcaccgggctatatgacattaatcgtcgcccgtctgctgacgggcctggcgcacggcgtgttcttctcgattggatctaccatcgcgacaagtctggtgccaaaagagaaagcggcttctgcgatcgctattatgtttggtggtttaacggtagcgctggtcacgggcgtgccgctgggaacatttatcggtcagcattttggctggcgtgagaccttccttgcggtatcactgttaggcgtgattgcgctgatgagcagtcaattgctgattccggccaatattcccggtcgggcggccgccagcattcgtgaccaggtgaaagtactgactcatcctcgtctgttgctgatttacgccgttacggcgctgggctacggcggggtattcacggcattcaccttcctggcgccaatgatgcaggatctggcgggattctccccggcagcggtaagctggatcttactggggtatggcgtatcagtggctatcggcaatatctggggcggtaaactggctgataagcatggtgccgtgccggcgctgaaattcattttcgccgcgctgtttgttctgcttatggtcttccaggtgacggcctccacgcagtatgctgcgctggctaccatcctagtgatgggggtctttgccttcggtaacgtaccggggttgcaggtctacgtggtacagaaagcggaacaattcacgcctaatgcggtagatgtggcgtcaggtctgaacattgcggcgtttaacattggtattgcgctgggctccgtgattggcgggcaaacggtggagcattacggtttggcgcagacgccgtggattggcgccctcattgttctggtggctttcctgctgatgggtgtcagcggacgtcttgataaacctgtacgcattgctctggagtaaattattgatgtaagcgcctacttacaaaacaaactgcaattgttcgttgaaagtgagtgctaaaatccctataacagaagaaccagtccggttgaggactggttgacgttacagaggtttgaaagtcaaaagtgcgaaaaaacacctatgcgatgcgctatgttgccggacagcccgccgagcggattttgccgccagggtcgtttgcgagcattggccaggcattgcccgccggggaaccgctaagcaatgaagagcggatccgtatcctcgtgtggaatatattcaagcagcagcgagccgaatggttatcggtgctgaagaactacggcaaagatgcgcatctggtcctgttgcaggaggcacagacgacgcctgaactggtacagtttgccaccgctaactatcttgccgccgaccaggttcccgcttttgtactacctcagcatccgtctggcgtcatgacgctttctgccgcccatcctgtttactgctgccctttacgggaaagagaaccgattttacgtttggcgaaatcagccctggtgacggtatatcccttgccggatacccgtttattaatggtagtaaatgttcatgcggtaaattttagtctgggcgtggacgtatacagtaagcagttacttccgatcggcgaccagattgcgcaccatagcggccctgtcattatggcgggtgattttaatgcctggagccgcccacgtatgaatgcgttgtaccgctttgcacgtgagatgtcgctgcgccaggtgcgtttcactgacgatcagcgccgtcgtgcgtttggacgaccgctggattttgttttttatcgtgggttaaacgtgaatgaagcctccgtactggtgacgcgcgcttccgatcacaatccgctactcgttgaattcagtcccggcaaacctgagcaataaaggtgagtcaggtctgccgtggggcaggcctctgcgggtgctgccctctatttttctcataacagaagggcactaccatgacaacgcattcccaccatgacaatgttgaaaagcagtttggttcacaggcgaacgcctatttacatagcgccgttcacgcagcgggtcgtgacttagcgcggctggcgcaaaggttgtctgatttttcccacgcgagcgtactggatatgggatgtggggctggacacgcgagttttgtcgctgcgcaacatgccaactcggtcgtggcatacgatttatccgccagcatgcttgaggttgtcgctggagcggcggaagaaagacatttaagtaatattactctccggcaaggctatgccgaaaaactgccctttgaagatgcatcgtttgaggtggtgattagccgctattccgcgcatcactggcacgacgttggtcaggcattgcgtgaggttaatcgtgtattaaagcccggtggcgtgctgattatcatggatgtcatgtcgcctggacatcctgtacgcgatatctggctgcaaacggtggaggcgttacgcgacacgtcgcatgtccgtaactattccagtggcgaatggctggcgatggtcaataacgcgatgctggtaacgaataccgtgataacagatcgtttatcgctggagtttcgctcatgggtaacgcggatgcgtacgccagcgccgttggttgaggcgattcgattatatcaggcgagcgccccggtagaggtgaagcgttattttgagttgcaggatgacggttcgtttagcagcgatactatcatgctggaagcgcataaagcggtatagcaatttaaaaggcgccgggggaagcggcgccttttggctttttcgtcggacaatatcaggagtctggcgtgctattgtccttcacaaacaacgtaagctgatcgcccggttgtagattatccgtatcatggttccagcgcatcacatctttgatattcaccccgtgacgtctggcgatactggaaagcgaatcgcctttacggacacgataggtaatgctatcgctattgtttgccagtcgttgcgcgctgctgccagcgcccacggtcaggctttgcccgattttcaggcgtgaaccacgcaggttgttccactgctgcaagtccttcgtgcttacgccaagccgcgaagcaataccggaaagcgtatcgccagagcgcaccttatagctacggctattcaacggcgtattgtcggcgatcagttgggactgaacggcgtcaatctcaccggaagccagcgactcacgcaactgctcggcatgctttttgggcaccataacatattgcggaccgcttacgcctaaggtagacccttttacaccggcattaaacgtcttcagcttgctgatagacatgcccgccatatccgcaacctgcgccatttcaactggactgtttaaacgaactcgtgccagcgctcggctttcatctgttgttggcagacgtacgccgtagcgtttgctgtttttgagaatttcactcaatgccagcatcttaggtacgtagagttttgtttctctgggcaaagaaagcgaccagaaatccgtcggttttccacgcgctttgtttgctttaattgcccgcataacacggccttcgccgctgttatacgctgcaacggttaacagccagtcgccgtcaaacattttgttcagacgctgcatcatgtctaacgcggcggtcgtagaggctacaacatcgcgacgcgcgtcataattacgggtctgctttaaaccataattgcgccctgtgctcggtatgatctgccagatgcctgcggcattggcgccagacgttgcgtgaggatcaaaagcgctctccactatgggtagtagtaccagctccataggcatgttacgtttcttaacctgccccgctatccagtacatatacggctctgcccgtaaagttacatcgtggagatagctcttattgcgtaaatacttctgtttctgttcgcgaatccggctgttttccggaattcccatctttagctcgtcgccaatgaaagcccacaagtcctgatctggcgcgatagacgttccgtcgtccatccatcgtgcctgactcgtaaactttcctgcttccccttgaccagctgcagaaaggctctgtgcgtgctgttggacgttgccagtgttctgagacgtctggcaccccacaagcaggacagaggcgagtaatatcgcttttgccttcatgtgtgtgtcaatagttgcttaaaagacgaccgatcataacggcgaagttagcgaatgacaagtaagaattatcagaacgtgtctttctttgaccttaaccatgcaaaacgcgcttctggttgttgcaatattgtttctttgtttatttcgttaattaaatcaatatcttcagttcttaaaaaaagattaatcttacgctcatttttaagaataacgggtaatgtcatttgtttttttacacgtaactctttaactttacgataatattcatttatgaacgaatcgtgcggaagtatgctcaatgcgaacttaatgttagctaaagtgtattcgtgagcgcagcaaatgagcgtgtcgtcaggcagagagttaattttcataagtgactgatacatctgtgatggcgtgccttcaaacagtcgaccacagccgccggaaaacagcgtgtcgccgcagaataagtaagggcggctaaagtaacagacgtgtcctaacgtgtggcccggcgtggcaaaaagagtaaatttctcgcctaaaacgcgaatagtatcgccatcgccaacaagatgggttgctcccttgtcttgcgtttccgccggtccataaaccgtcatttgcgggaagtgttgcaacagctctttgactccgccaacatggtcgtgatggtgatgcgtcaaaaaaatcgcctccggcatccacttatgttcagcaatggcctttaagacgggggccgcttcgccgggatcaacaatcacacagcggccttcatcattggtcagcacccagatgtaattgtcctgaaacgcgggaatactgttaagattcatatattacctctcaaataattagcggaaggttgcgatgaaaccggcaaggctctctcaaactgtcgttgcgcccggatgttggggtgagttgccctggggcaattactaccgtgaggcgctggaacagcagctaaatccgtggtttgcaaaaatgtatggtttccatttgcttaaaatcggtaatttaagcgcagaaatcaattccgaagcgtgcgcggtctcccatcaggtgaatgtttcatcgcaggggtcgccgatgcaggttctggccgatccgctacatcttccttttgcagataaatccgtcgatgtttgtctgctggcgcatactttgccgtggtgtaccgacccgcaccgtttattgcgggaagccgaccgcgtattgattgatgacggttggctggtcattagtggatttaacccgctgagtttgatggggttacgtaaactggtacccgttttacgtaaaacaccgccctataatagtcggatgtttacccttatgcggcaactggactggctgtctttactcaatttcgaagtgctacattatagccgttttcatgtcttaccctggaaaaagcagggggggcggcttttaaatacgcatatcccggcgctgggctgtttacagcttattgtggcccgtaagcggaccatcccgcttacgcttaatccgctgcgacataataaaagtaaaacccctatccgccagaccgttggcgccacccggcaatatcgcaaaccggatggctaagcttccgcctggtagccactatcttcctgcgtgggattcattgccgcggcgcgcgccagttcatcacaacgctcgttttcgggatggcctgcatggcctttgacccatacccatttgatctgatgctgacctaacgcagcatcgagacgtttccagagatcgacattttttacgggtttcttttccgctgttttccagccgcgtttcttccagttatgaatccattgggtaattccttgccgcacatattggctgtcggtgctcaatgttacttcgcaatgttcttttaacgcttcaagcgcgacgatcgccgccatcagttccatacggttattggtggtcagcgtgtaaccttcactaaacgttttttcatgaccgcgatagcgtaagatagcgccataaccaccaggccctggattccccaggcaagagccatcggtgaaaatttctacctgtttaagcatctctggtagacttcctgtaattgaaatcgataacaaaacgcaagtctgacataaatgaccgatatgagcactgcaattacacgacagattgtcctcgataccgaaaccaccggtatgaatcagataggcgcgcactatgaaggtcacaagattattgagatcggtgcggttgaggtgataaaccgtcgtctgaccggcaacaattttcatgtttacctgaagcccgatcgccttgtcgatccagaggcttttggcgtacacggtattgccgatgagtttctgctggataagccggtttttgctgatgtggtcgatgagtttcttgattatatccgcggcgcggagctggtcatccataacgcatcgttcgatatcggctttatggattatgagtttggtctgcttaaacgcgatattcctaaaaccaatactttctgcaaagttaccgacagcctggcgttggcgcggaaaatgttccccggcaagcgtaacagccttgatgcactgtgttcgcgttatgagatagataatagcaaacgtactttgcacggcgcattgctcgatgcccagatccttgctgaagtgtatctggcgatgacgggcggacaaacgtccatgacgtttgcgatggaaggagagacgcaacggcagcaaggtgaggcgaccattcagcgaatcgttcgccaggccagccggttacgggtcgtttttgcctctgaggaagagctggctgcgcatgaatcgaggcttgatctggtgcagaaaaagggcggaagttgcctttggcgggcgtaatttattcctttttaggctataaaaatcatccttcgggcgatttttgcagcaactgattcaaaaggtgagaaaaagcgttgacgggcgacaccgcaaaccgtaatattcgcctcgttcccagcgggaacatcacggagcggtagttcagttggttagaatacctgcctgtcacgcagggggtcgcgggttcgagtcccgtccgttccgccagatacaaatctcagggtgtttttatacatcctgtgaagtaaaaaaaaccgtatcactgtaaaagggatacggttttttttcgtcttcaagaagttccaccgtctatcgtggaatctggcgcaaatgggcctacgcctggatgacgaacaggatattaccgccacttctttcactgtcatggctattttgatcccactgacatttaaggcgcggcctcatggcggtgcttaaccgggatcgggacatgttcagcgcagaagcagactgcgtaatgttgatatcactcagataattacggagaaccgccagacatgcgcatcatcactccagggcatcccacttctccagcaactccaccgggatctcattgatcacctccgagaaccgttttcccaccagtctttcagcctggcgtaacagtgggatggtcgggctactgggttcactgctctcaaaccagcgacgaatgcaccgcaggcgttccagcgcatcattacgatcgcgaattggccccggttcagcattgtgtgggagggatataccgggtggcgcgttgacaggcggcacatcctctgcccgtgccggaacggcattatccataaccgtgcctgcggggtctggcactggcgctggcgacggagggatttccggtgtggttgtctgtaccacgtcaggcagcagcgctaacaactgccgcaggcgtgaaaaatctggagccagatcgcctaatgtctcacgcgcccacacttgcaggcgttctgcgctttcctgcgcttcgcgaaacgccgccagcggtaatgccccacgggcttcgaggtcggccagttgctggcggacggattcgggggccagcgcatcagccgggcggggagcggataacgcgcgctccacatcccgtacctgtaggcgcagggcggcactgtttgacagcgtaataccgcgaatgtccgccatcacgccttcgtgatccagcagcgccgccagggcattactgcgcgccagcgacgcatcttcaatagattctgcggatgcgccttcgccggtaagcagctgtggatggagtgcatcagaccagattacgctcagttctgccagttgtgtgagcatttccgccagtccctgtgcgccagcctgctggatgcgactgcgcagcagcaggatcaacacccggatatccttactgcgcgtgagcagacggcgcgcatcacgttcaatttccggccagttcacggcttccggcgtactgacaaaatcaccatattgcgcctccgcctggggggcggcgcggctgaacagcagcaggtattccggatcgtactccggatcggggccgcagggttgttccgcgcttaccggtttagtcagggacatgtccatatcattactctcagtgggttaagccgtgttcaggttcaaaaatcatgccggtcaccggacggtcatgcatggctttacctgcccaggccgtccagccaagccgctgcgcgccgccgatcaccgcaggcggtgcggcatgaggcttcaactgcagctcaatttcccagcaatattcaaaaccgatgaacgtacgcaccagttctgtcagcacgggcagattgttgccgccgggcagaaaacgcaggtaatcctccagcgtgagcgggccgataattagccggaatttgtactgcatatccggtacggcctggccgataagcgccccgttgcccagcaccgaagactgcgcgggcgtgcccagacgggtgatttcatcgttcgccaccgttatccagtgcagggcgaattctttcaccgcaaaaggtacgctgaaatagtgcgccagcgtggcggccagcccgtcaggattgcgcgattcgcgtaccagatgggcggaggctgccaggcgaacatgatctgacagcgggctttcggcgctttcccgtagatcctgcccgctgagactggcgatataaaacgcaaaacggtcgtgttccggtttgtccagcccgccaccagcggactgggcgctgcgccatgcctgccagaactgcgtcagccagcggtggtgaaaaatattggaaaaatgaaccagcgtcggatcgtgacgactctctgagcggttcagtgccagctcggtatagtgcagcggcaacgggccgtttggcccccatagtccgaggctgtacaggctcaggtgcaggcgtccatcctgccagctgacctgggcgatttcccgtggcgcaaaggtcatcgtcggcgtctgtcccagacggaatttttccatccgtggctgccagatactgcctgccggagtatcacagagctgggcatccacgcgccgcatcaggttcaggaatccgtaacgccagggggttttctgcgcctggttgagagcgccggtcatacgctcccccgttgcccggttctgaccggccaggtcatgacatgcccgcgttgcatcgagtgcagcgtcatctgcgagaaggtattaatggaaacatggcgggcaatatagtgttccagcaccagaccgaacaggtaaggactgataccggaaaatccttcttcgtccacggtcagttcgcaactgacgccccggccatagaccaacaggccggagccgggcaggcggcgggtcaccggggtggttttgcagccaatcaggctgcgcacctggcgcgactgcgggctgtcgtgagccgggataaacagattcagcagatcgcgcagcgcctggccgccggtgcggtgatccagatcggccagcggcagataattaaacgacaactgccggatcagccgccaggccatttcgcgttcagccagcggcggctgcggcgggcgcggcggtctgataagacccacgcccgccaccggaatcgccgcatctacggtcagatcatcccggccattacgtggaataaggcagggcagatcgcggttagtcaccattgccgtgacggtgatatggcgcagattttccgggtagggcgcttcatgctgatcaaccagcgagaggaagacttccgagccggtatagggggttcgggtgccatagcggcgggcgttttctgacgagcggcgcggttcacgacgcagtgaaaaataacgcccgtggttgccttcgtcattattacgggtgtgatacagcggacgaaaaatcatcttccgtgtggtttccgcttccaggccttcgacttcctgaacagaaaacacctcgtaatccagcggacgggtacgatccaccaccagatgctgttccgtcacgctgtgagtgacttcaatccgggtggtggtgcgaggaaacaggttgatcaccggcgtacagaacaggctgaactgtgcagcgtccgtctgatgaatcagccagtccggcggcaggcggttaagcagtatgacaatttccgccacattgccctgcaccttttgtaacccggcagacaatccggtcggggtgaagaagtaaaaccgttccggacaggcgaaaaattcatgcagcagattatggccgtgaaacacgttccaggcgagcggtagcagcccctgccctggctccagcccttcgtgcgccaccgggtgttgaagattcacattcagttcgccgtcaaagtgaccgggttcaccggccagtgtggcgacggcgctggtatgtagcagctcaaacaggtgtgacgcaatgcgttcttcgccgcagaggtaaaagggcagccgtgccggaccggccagctcgctgaaagtcagttccccgaaggttcgcagggtgatgcgcaatgccccggcgacatgaatattaggcggcagatagcggtgcagggcgggcatatccggcggcgcggcggtcaggcgtacctcctcgatggacagcggccacagcgtgacgtcctggctgctgcgaaactggcaggcggtattttcgccttccgggatgggggaaacgaacgcggtatcgcgcggcacggtgacccctttcgccaggtcgccttcctgcgtatcgggatacagctttaccactgccatcgatggcgtgggggtgacgtaattggggctgacgacttccagtaaccgctgtgtgaagcggggaaactcggcgtcaatttttagctgagtgcgggcgctcagaaagctgaacgcctcgatcatgcgttccacatacgggtcggcaatatcggttccctgcatccccagtcgggcggcaattttgggatggagggtggcgaactcagcaccggtctcccgcaggtagctcagttcgcggttgtaatactccagtagccgtggatccatgaataatgccctgtattaaaagaacgtaatgcggctcagctccatatccagcgcgctgcgtaccagaaactccgtgggatacggctgcgtcagaatttgtccgcgaatttcaaactgtagcgtgttatagctaccctgccgggttttatcgagcaagggcgtgaccctgagtgtggcggcgttcagccggggttcgaaacggataatggcgcgccggatcgcctcgctgatatcgtcccacttatgctcatacataaagctgcccgccagcggcggcaggccatagttgagcactgacgccgccgcctgcggatagcgccgggcgtcgatgtcaccctcgtggctaatggtattgagcaaaaaggagagatcccggcgaatgatctccttcagttgtaccggcgtgacgctgatatcccggtcaattttctgatacggagcattgtcacacagccgatcaaacagcgtgggcagcaggtggttagcgggtgtaaaacgagacgtgctcatgcgccatcgttttcctgagcatgaaaggtacaatgggccatgtccagcaggctgatatcgccgtggctggtcagccacactttctgccccagcgcccgcacggtggtttcgccggggccgtcctgccaggcggtttccctgcacagacgcagggcgtcggatgcactttccgaaccgctgtaacgggtaaagagccaggcgccgtgcgtatcgccattcaccagggtgatattaacgggtttccacagcagatcagtcaggcgcgtcggttgcggcgattccagcgagcgtatttgcgaaaacggcagccagatatacacgccgccggtgactagctcaagtaccgggccaaggcgggaatcgctgtcgctcgcccagtcaaatgcgccgccgttccactgcccgcccgtgtctgttatggcttccagtgcggtattacggtgtttatcaacctcaccggtatcgtcatgacaggcgagtgccgccagcagtgactccacccaaacgggctgcggcagaagaaaaccgggtcgttgttcaccctgaaaaacggtgtggcggaacatttcgcagcgaaccagctcccggtacagccgggcctcctgggtataattggcctccatcctggcgcatagctgaagctggtgtagcgcccgcgaccagtctccggccacacacagcaactgaaacaggctgtggcggcagagcgctttcgccggattttcccgaacctgctgctccgccatctgaatcccctccgcaatagagtattcctgtatcagcgcggacagggtagcaggaagcgtgtcagtttttttcatgggcggtatttccatttttctgtgtcggagtgattcggtagtggctatcgatgccaataatacgatgctcgcggcgggtcagatcgggcagtatctcgctatgtgcggttttcccccccagttccggcgagagcagttgcaggatatcgggcattgattccatcgccagccagtgcatttcaccctcaccggtcgtgtccagcgtatccagaatggcatcaataccgggcgcgcctgccaccatatcctgtaacgtgtcggtgtcgccctttttatcgtataacgacgtcaaatcctgggtgacagcgtcttcatttcggggaaacggtttagcacggaggggcttttcctgcccggagggccgcaatgcctgctgatattcctggtaaagctggtgtagtgtgctatccgcttcatggccagtgtaagaggatgcggtttcccggacgggaataatatcgaacgggttctgcggattgagctgttgttgtttaaaccagtccagatccaggtactcagcaacggattcagatgactgaaccaactgaggaaacgaaacatcgggacgggactcatcattggtgcgggcaaggcaccaggatgacagaccccattcaatcgtatctccatcattcagccgcatacggtgatgaggttccatcacctgctcattgacggcacagcacagttcatcagagtgattaacaatccaccacgcctcttcgtggcgaacaagactgagcgcgatatcgtctttcccatgttgctcaaaaagcggaatgtagggggcggcggcagtaaatacgatgtatgtccctgcgggatactgtgcgttatccgttataccctgcgactgtattttccgtaattcccacatgtcttgtttcattatgtcccttaaatgtatttatttttctggaggaaacgtttagggagttttaattcataaataattttaactaaatttatagggagtcattattgatgacaccctttttattattttcgtcgtgaatgcattgttgtatgcatagatgtcttttttgaaatattatttcttttaattctgcaattgcgatttttatcttgctgttcattgattatttaatattaacggcttagttgctaattagtccctgatctgtatcattgttttgtttcgatattttttcgaggctatcaataaagaattgtttatatatttatatgcattgatgcattatttttatgaatttttatgtcacaaggcataacacatggaaactcctgtttcacgcagtgcgttgtatggaaaactggccggcccactattccggtcgctggaatcggcaacggcattttgcaaactacgctctaatccctgggttgagctgactcactggctgcaccagttaacacagcagcccgataacgatattctccacgttcttcggcattaccagatccctctttctgatgtggagaaagcgttactccggcaactggatatgctgcccgccggggccagcgccattagtgatttttctcaccatatcgatctcagcgttgaaaaggcctggatgctggcgagcgtccgttacggcgataacaaaattcgcagcggctggttgctgctggccttgttgaccacgccagaactgcgtcgggtactgagcagtatctgcgcgccgctggccacgcttccggttgatgaactgacggaaatactgccctcgttgatcgaaacatcgccggaagcgcaggagcgcccttacgacggctccggcctggcatcagccattcccggtgaaagcagtcaggcgattcccaacggcgggcaggacggtaaatccgcgctggcaaaatactgtcaggacatgacggcacaggcgcgcgacggcaaaatcgacccggtgacggggcgtgagcatgaaatccgcaccatgacggatattctgctgcgccgtcgccagaataatccactactgactggtgaggcgggcgtcgggaaaacggcggtcgtcgaaggttttgccctcgcgattgcgcagggggaagtgccgcccgcgctgcgggaagtacggctactggcgctggacgttggcgctctgttggccggagccagcatgaaaggcgagtttgaatcgcgtctgaaagggttactggaagaggccgggcgctcgccgcagccggttattctgtttgtcgatgaagttcacactctggtgggcgcgggcggcgcatccggcacgggcgatgccgctaacctgctgaaaccggcgctggcgcgcggcaccctgcggactatcggcgccaccacctggagcgaatacaagcgccatattgagaaagatccggcgctgacccgtcgttttcaggtgttgcagattgccgaaccggaagagatccccgcaatggaaatggtgcgtggtctggtggatacgctggaaaaacaccataacgtactgattctggatgaggcggtacgtgcggcggtacagctttctcaccgctacattcccgcccggcagttgccggataaggccatcagcctgctggataccgccgcggcccgcgtggcgctgacgctgcacacgccgcctgccagcgtacagttcctgcgccagcagctaaaagcggcggaaatggaacggtcgctgttgcagaagcaggaaaaaatggggattcagtcagatgagcggcgcgatgcgctgatggcgcgaattttctcgctcaacaatgaactgactgcatccgaatcccgctggcagcgggagctggaactggtacatacgttgcaggaactgcgtctcgcagagtctgatgctgatgacaaaaccacgctgcaacaggccgaaacggcgctaagggagtggcagggcgacgcgccggtggtgttcccggaagtcagcgcggcggttgtcgcggcgattgtcgccgactggaccggtattcctgctgggcgcatggtgaaagatgaggccagccaggtgctggaactgcctgcccgactggcgcaacgcgttaccgggcaagacggcgcgctggcgcagattggtgaacgtattcagaccgccagggcgggactgggcgatccacgcaaaccggtgggcgtgtttatgctggccgggccgtccggtgtcggtaaaaccgaaaccgcgctggcgctggcggaggctatctacggcggcgagcagaacctggtaaccatcaatatgagcgagttccaggaggctcacaccgtttccacgctgaaaggcgcgccgcccggctatgtgggctatggcgagggtggtgtgctgacggaagcggtgcgtcgccacccctggagcgtagtgctgctcgacgagatcgaaaaagcgcaccatgacgtccacgaactcttctatcaggtgtttgacaagggtgggatggaggacggcgagggtacacatgtcgatttcaaaaacaccacgctattactcaccaccaacgtgggttccgacctcatcagccagatgtgtgaagatccggccttaatgcccgatgctacggggcttaaagaggcgctaatgccggaattgcgcaagcatttcccggcggcatttctgggccgcgtgacggtgatcccttacctgccgctggacgaaacgtcgcgtggcgtgattgcccgtctgcaccttgaccggctggtggcgcggatgagtgaacagcacggcgtgacgctgacgtatagcgaggaactggtcgcacatattgtggcgtgctgtccaatgcatgaaacgggcgcgcggttgctgattggctacatcgaacagcacattctgccacgactgtcgcgctactggttgcaggccatgacggaaaaagccgcgatcaggcagattgatatcggcgttaatggtgatgagcagattgtttttgagatcgtttgctgaaaccggccgttcgaagtgtccgtagtgcgattttaaaaactgtaccggtataccgctccccttgcggcaaccagttgactaaaaaggaaatgaaggattatggctatcaacaatagcgcgcagaaattcatcgcgcgcaaccgcgcgccgcgcgtgcagattgaatatgacgtagagatttacggttccgagaaaaaaatcgagctgccgttcgtgatggcggtgctggccgatctggccgggaaaccgcgtgaagaactgccgccggtgacggatcgcaaattcctcgatattgatattgataacttcaatgagcgcatgaaagccattgcgccgcgcgtggcgttcgctgtgccgaatacgctgacgggtgaaggtcagttgatggtcgatatcacgctggaaaatatggacgacttttcgccggcacagattgcccgcaaggtggacgccctgaaccagttactggaagcccgcactcaactggcgaacctccagacctacatggatggcaaggcgggggcggaaaatctggtcaataaactgttgcaggacccgactctgctgaaaacgctggcgaatgcgccgaaatcggccgctacccagcaagatgtgtcagcggataatgaatcagcggaataacgtcgaatttttaaggaattttcatggcaaacagtaatatgcaggcaaccgacgcggttgctcaggataccgcctccgcatccggtgaatttgatgcgttgctgaatcaggccttccgacccaagactacccaggcggcaaaagccgtggaagccgcggtgcagacgctggcgcaacaggcgctggcgaacacgatcaccgtcagcgatgacgcctataaaagcatcagcgctattattgcgcagatcgactttaaactgaccgaacagatcaaactgatcctgcaacatcccgactggcagaagctggaatcctcgtggcgcggtatggagcatctggtttacaacaccgagaccgacgaaaagctgaaaattcgcttcatgaatctgtcaaaagatgaattgcggcgcaacatgaagcgttacaagggcatcgcctgggatcaaagcccgatgttcaagaaactgtatgaagccgaatacggccagttaggtggcgaaccttatggctgtatcattgcggattactacttcgaccatacaccgcccgatgtggatctgcttggctctatcgccaaagtcgccgcgtcggcccatgcgccgtttattgccggggcttccccctcggtactgcaaatggactcctggcaggaactggcgaatccccgcgacctgaccaaaatcgtcacccagaacctggaatatgcgccgtggaactcgctgcgggctagcgaagactcccgttatattggcctgacgatgccgcgttttcttgcccgcctgccgtatggcgcaaaaaccaacccggtggacgagtttgattttgaagaagatgcggatggttctgaccataccaaatacgtctggagcaacgcggcctacgcgatgggcgtaaacatcaaccgttccttcaaacactacggctggtgtacgttgattcgcggtgtggaatcaggcggtgcggtggaaaatcttccctgccataccttcccgactgacgatggcggcgtggacatgaaatgcccgaccgaaatcgccatctctgaccgccgcgaggctgaactggcgaaaaacggttttatcccgttgatccaccgtaaaaactcagactatgccgcctttatcggcgcacagtcgctgcaaaaaccacaggaatactacgatccggacgcgacggccaacgctaacctgtctgcccgtctaccgtacctgttcgcctgctcgcgcttcgctcacttcctcaaatgtatcgtccgcgacaaaatcggttcctttaaagagcgtgaggatatgcagcgctggctaaatgaatggattatgaattatgtcgacgccgatccggtgaactcctcgcaagaaactaaagcccgtcgtccgctggctgccgctgaagtagtggtggaagaggtcgaaggcaatccaggttattacgacgcgaaattcttcctgcgtccgcatttccagcttgaagggctgacgggatcgctgcgcctggtgacaaaactgccgtcagtgaagcagggcaatgcctgatatatattttgtgaatgtttaagcgagtgaagtcagagaagatagagaatataaagagggatatgaagaaaagaatttcgtctcgcccacggtctcgtaaaggtggggtacgtaatgatgacacatatccgaatgccagtaacaatgccgaagctttttatatcattgagtaggaaatacatattatgaccataagcccaacttttcatctgttacctggtattgttctgctcttttcacaatatgctgtagcctgggaagtcagttgcccggctgttattgatactcagtcttctgctgtgagcctgaagtctgatgtcccagcggcgtggcagctttctccccgatatatgtcgcgtttatggttaagtagtattggggtaacgcagggtaaacctgaaaacctgatggatctcaaaccagagactaaaaaagtaaacggtgaaaattggtctgtatgggaaacagaacgtggtagcgataaagaaaccgatcgctattgggtttcgtgtatttatggtcatgaacagatatggttgacgcaaccaatacctgcttcttctactcgctgtaagactcgtaattttgagggatcgccagaagaccagtctgtatcttttatctgtaattagcgatttgagacgtgaaaatttcagtacaggttatggtttttattatcggaagttatgaagcattatttatatgcattaaataatgcaaattcataaaataactaaatacattatcggtaccggaaaaatatacagtcctctgttctcctgaagttattggagaaggattctgtacggcaatgatttatctataaacaaaaagatatagataaaatcaggtttattttaagtaaaacttaataaggatataaaaatggcttatgacatttttttgaaaattgacggcattgatggcgagtcaatggatgacaaacacaaaaatgaaattgaagtactgagctggcgctggaatattcatcaggaatccaccatgcacgccggtagcggcctcggctccggtaaggtctccgtcaccaacctggattttgatcactatatcgaccgcgccagcccgaacctgttcaaatactgcgcctccggcaagcacattccgcaggccattctggttatgcgtaaggctggcggcaatccgctggagtacctcaagtataccttcaccgacctgattgtcgccgtggtttccccgagcggcagccacgatggtgaaatcgcctcccgtgaaacggtggagctctccttcagcaccgtgaagcaggaatacgtggtgcagaaccagcagggcggcagcggcggcaccatcaccgcaggctacgacttcaaggccaacaaagaaatttaacggctgtttttccggccagatgttatgtctggctggttttattgttttgattttaaaggaatttacagtgaataaatggcgtaaccccactgggtggttatgtgcggtagctatgccttttgcactgctcctgctttccggatgcggcagtagcgattcgctacttgacccctaatcgcagcggcctggcctgagcgtgaaagcgttttacaaggtgaattctgacaatcagaagaaagcggcgtccatgaagatacgtgttgagaattaatgacctacacagaatttttagaggttaagcaaaatgaacagaccttcattcaatgaagcgtggttagcttttaggaaggtgaatcattccgtcgctgatgtgggtagcattattggtggaaacgttgggaaaaatataactggtggttattttcaaaatgcctgccctattcgaatgagctatgttttgaatgcgacagggttcccaatagcccgtaactctccgtatgcaaaggttagtggtgccgataataaattctatatttatcgcgtgaatgatatgattgattatcttactcatactatgggcaagcctgatcttattgttaataatccgaaacagagtgactttatcgggaagaaaggaattatcgtagtaaaagggcatggctggagcaatgccagaggacacgttacattatggaatggcagtatctgttcagatcagtgccacttattaaatgacccagataatggaccatttgttcctgaagttgggacactgtggatactgccgtgaaatggttaatattagttactttcagcataagtggaatgctggtatggcagccatcctttgcacaagaagcattgaccacacaatattcacagtcggaactcttaaaaaattgggcgctgagtcattgtctggcattagtatacaaagatgatgtcgttaaaaacgatgccagagctacggccagtgcttaccttgaatatggtaaacaatctgtggagatttaccatgaaattgatgagattgcgaaaaaatattcagggttgaaatataacggttcgatatcatcagattttaataccatgaagtgcatagattttatccatgacagggaattaaatgaattaattaaaaggcgtgtcgagaagtaaaattcaaagatattaaaagcatacgttctcttgctctgatgaatttatgggtaagaaagagctgtacaggaatagttaatctgttcacctaataaagcagataaatcagggcttaatttaggtagttaaaaggatagtagatatgtcttatgacatttttctgaaaattgacggcattgacggcgagtcaatggatgacaaacacaaaaatgaaattgaagtactgagctggcgctggaatattcatcaggaatccaccatgcacgccggtagcggtctcggttccggtaaggtctccgtcactaatctttcatttgaacattacatcgatcgcgccagcccgaacctgttcaaatactgctcttccggtaagcacattccgcaggccattctggttatgcgtaaggctggcggcaatccgctggagtacctcaagtacactttcacagatctgattattgcaatggtatcgcccagcggaagccagggaggggaaattgcgtctcgcgaatcaattgaactctccttcagcaccgtgaagcaggaatacgtggtgcagaaccagcagggtggcagcggcggcaccatcaccgcaggctacgacttcaaggccaacaaagaaatttaacggctgtttttccggccagatttatatctggccggatttattattttgattttaaaggaatttacagtgaatgaatggcgtaaccccactcggtggttatgtgcggtagctatgccttttgcactgctcctgctttccggatgcggcagtagcgatgcgttacctgacctcgaatcacagcgactcgacctgagcgtgaaagcctccgataaggtgaatcctgacaatcagaagaaggccgcgcccattgagatacgtgtttatgaactgaaaaatgacgccgctttcacgacagctgattactggtcgctccatgacaacgacaaatccgtccttaccgacgatttagtgcgtcgcgacagctttattttgcgtcccggcgaagagaaaaaactgcgtcgcccgctgaatgcgcagaccacggcaatcggcgtactggccggataccgtaacctggccaaatcggtctggcgggtaacctacaaaatcccggaagccccggaaaaagcctggtacagcagcttcatatcggggaaaggaaaagtgcagttggaggcggaactggaacaaagcgccattgtaattacggaacgggataaatgaattatgagctggaatgaccgcgtagtctggagtgaaggacaatttttactgccgcagatgtttcagcagcaagagcgttatctggaacacgtcatgcattaccgcagcctgccgctgaccccctttttctggggattcagccactacaatattgatggcgaagcgctgaacatcggtaaactgatactgaaagaggcatcagggatttttcctgacggcacgccgtttaacgcaccggaccacaccccgctgccgccgccactgaccattctgccggagcacctgaaccagcagatttgtctggcggtaccggtacgcgcgccgaacagcgaagaaaccacgtttgacaataacccggaatcattggcgcgtttctcggtacatgaacacgacatccgcgacgccaactcgctgggacgtggcgcgcagttattacagctcagtcatctgcgcctgcggctgctgccggaaaaggcggtgacgggcgcctggattggcctgccgttgacccgcatcaccgggttgaaccctgacgggcggatagatatcgaccacgacctgatcccgcccatcattaattatcaggccagttcactgatgtgtacctggctgtcgtggatcaacgatctcatccggatgcgggccgattcgctggcggaacggctgaccggcagcgacaaccacggccatgaagcagcggaggtctccgattacctgctgctgcaaattctcaatcgctttgagccgctgctgactcacctggcgaaaaccccgctggccccggaggtgctgtaccgctacctgtccgaactggccggggaactctccacctatgtgcgtccacaaacgcgacggcccgctgaatacaaagagtacaaacacctgacgccctatgccgggttgaaatcgctggttgatgaggtgcagttcctgctgaacgcggtactgatccggggcgcgcagcgcatcgagctgaaagaggggacttacggcatcctgaatgcggtggtggccccttccgatcttgccgatttcagcacgctggtactggcgataaaggcttcaatgccgaccgatgtgctactgcaacattttgccgcccagaccaaaatcgggccatccgatcgcctgccggaactgatccgctcgcatctgccggggctggctttgcaggttctgcctgtaccaccgcgccaaatcccgtttcaggccggatacatctattacgacatccgccgcgagggagcattgtgggaacacattgcccgttacggcgggatggccatgcataccgccggggaatttccggggctggagacagaactgtggggagtgcgcgataaatgacagacagtaccctgacgccgccagcggcggatatgatgtcctttttgtccaccacgccggaacataaggacagtgaatatgaaacgccggtacacaccagccagcgcacggaactcaatgtcatcgttgaagacggtccggacagcaaactccggctggctgaaatcagcgcggcggctaacccgttgctcgccgctgcccggcctttattgtgcgctctcgcagccatgcccgctaaactggatgcggccctggtagagccttaccgtaatctgctggtacgcgagatgcatctgtaccagacattatgcgatcaggcgaacctgcggcgcgagcacgtactggcggtacgttactgcctgtgtacggcgcttgatgaagccgccaataacacaacctggggacggcgcggcgtctgggccggaaaaagcctgctggtaacatttcatggtgaaagcgaaggcgggataaaacttttccagatcatcgggcgtctggcggccagcttccaggagcatggcaacgtactggaggttatctaccacctgctggggttgggatttgaaggccgctacagcgtgcagccagacgggcgtaagcaactggacaatattcgccagcaactgctgacacagctttcacagcgtcgcgatccggttatgcccgcgctctcgcctgactttcagggggcgataagcggacgactgcggcggatgcgccgggtgccggtctggctgagcgccgggatagccctgttggcgatgctgacgctgtttggcctttacagccaccggatggatgtgcagaccgtcaccgtacaacagcatattgatgcgattggtataaaactgccgccgccgcctgtgccggttcataagctgcggctgaaaatcctgctggcaaacgaaatcgcccgtggcctgctgaccgtggacgaagatgaccagcacagtagggtggtcttccgtggcgacgccatgtttgtgccgggacagaaaacggtgagtgacgcaatccggccagtgattaacaaagcggcgcgggaaatcgcccgcgtgggcggcgcagtcactgtaacgggtcacactgacagccagcccattcattcggctgaattcccatccaacctggtactgtcggaaaaacgggcggcggaagttgcggcgttgctgacctccggcggcgtacctgccggacgggtacatatcgtcggcaagggcgatacggtgccggtggcggataacggcagtaaagccgggcgggcgaaaaaccgtcgggtggaaattctggtagtggagtgaatgaatgatgaaaaaatcaacctatgatgtgtctcatcattcggcagtatgtggcgtgacgggggattattatcggatctcagcgacatatcacataacacgatctgttcgtgtttttttgatcatcttatgttgcctgttatccggtggcgcttttgccggatccccgattaacgcaggattcatttcccccgataatgtcaacctcagtactcaggatttcctgaaattttatgccactgacaacgtacagaaaaaagacaatgcactgatgtatatgctgggggtggaggatgcgacagaaggtaaagcctggtgtggatatggtcaggttgacagtataacaataaaccatactgtgctgacctggtttgaacagcacgcagtgaaaaagcctgatgtaagggcttcaatactaatagaggaagcattagttaaaaattttccctgtcagaggacagactcctccataaaaattgcttcccggtcatctcccattttatccctgacgccggatgcgcttaatctttcaggtaatgacttttttaaattttgggtgtctggtaatcaacgggataaactcagggcgggtgtctatctgctcggcgtggaggatgcgacagagaacaaactgtggtgtggatacgctttatttaagacgctaacattaaatgaattagtctatgtttctcttaaaaataaaaccaatgaggaactgaattctcgcgcggctgaacttatcataaataaattaatagagtatccctgtaatatataaaatcattcaagttgcatcaaggcggcaagggagtgaatccccgggagcgtacattagttcgtgactggggtgagcgaggaaagccaacgcacatgcagcctgaagtatgacaggtataccctgtgataatgttatcgctgccagttcagataaagtcttggtggtaaagtcttggtggtaagatattgatatgtttaaggtaatggtctgtctgttggtgggtgttcctgccatttcttatgcgcacgattatgggtgtgctacggttggagcatcaatggagtcatcattatttgatgccataaaaaatgacctgaatatagatgtcgctactattataaaggataaaacaaaggtagagattcttgatatctcacctgtatctaaggtctatgcagaatctctggccaggatggattatgaaaaagataaggccaaaaataaagtggcaatattagataaaaaatcctatttcgatagttactatgaaaatcaggttaaatctatcgtggcaaaatatacctatattaacaaagataaagaaaaagatattttcattgcatccagcttcatgaatgctgatgagtgttctgtaagatttaatggttatattactttatccagggaattttaaaatattgattattgggtggcgagtcgaaatataatgcaaaaatttcttagtctgcttttttcccggcgcgcgctggcagttgtgggcgttctggttctggcgctgctggtctggtttgtcgggccgctggtgtcatttgataccctgcgcccgctggcctccgtgggtagccgggtagtgaccattgccctgttgctgatgctgctggtactgtggctggtcaactggtcgatgagtatcatcggcatcagtgtcctgtgcctggcgattggcttcgtcacaccgctgctggccctgggcgatgtccatccgtttgcgccgctgtgggtccgcctgaccctgattggtttcatcctgctgatgtacgcgctgtacggcctgtaccggctgtggcgtgcgctgcgtatggatgaacaactgctgcgtcgcttcctgcatccgcgcggggaagaggtaccggtggcaggcgagatcaaagccgacctgcgcaccgtcaaccatattgtcacgcaggccatccggcagctgcggcagttgcgggtggatatgcctggctggcgtaaaatcttcgagggaaaacgctttctgtatgagctgccgtggttcatggtggtcggcagtcccggcgacggcaaaaccacggccctgctgaacaccggattgcagttcccgctggcggagcaaatggagcagacttcgcgcatcctgacagtaccgggtggcggcacgctacactgcgactggtggtttaccaacgaagcggtgttgattgataccgccggacgctacgcccgccacgatgacggtggtgaagcgagcgccgcgcagcgtaacgccggagagtggcagggctttctcggtctgctgcgtaaacatcgccccggcgcgccgcttaacggcgtgatcctgacgctaaacgtggcggatttaaccgcacagtcaccggcggaacgcctggcggcctgcgccgctctgcgggcgcgactggcagaactgcgcgagaccctggggattcgctttccggtctatctggtggtcaccaaaatggatttgttgccggggttcagcgaatattttcgcacgctgaccagccatcttcgtgcacaaatctggggcttcacgttgccgtacagccgcaggcgaaaagcgggcgacccgcaggcgctgcacgccgcctgcgcgcaggagctggcgcgcctgacgctgcggttggatcagggactggatacccggttacaggaagagtacgaccttaaaagccgccagcggctgtataccttcccgcgtgagttcgccgccctcggcgagccgttgctggaggctattgaacagatcttcctcgattcaaaattcgatgccacgcaactgaataacacgctgcgcggggtgtttttcaccagcgccgcgcaggcgcaggccgacgccgtggccgaccagttgagtatctggcagcgctttgtccgggcgataaaaaccgcccgtggcgaatcctccgcctctctcccacacgctctgccggacggcaaccgcagctacttcctgcatgacctgctgacacagtttatttttcgtgaagcgcacctggtggagccaaacctccagtgggcctggcgttaccgcctgctgcgcctcggcgggcacctgctggtactggtgctggcattcctgttgtggcaggggatgcagaccagccagcagaccaacggcgactatctgaatgaaatcagcgcccgcgcgacccggctggacggtgatgtgaaagcctacaccggtaaaccggcgatggctcccgtcccggcactgctggacagcgcaagggaactgtccgcctggccggaactggacccggacgcgccgccgctggcctggcgctacggtctgtacagcgtaccgccggtaaccgacagcgtggcgtcgctgtacaaccgtctgctggatcaactgctgctgccgccgctggtgaaacggatggagtatgtgctggcggacgccattgcccgtcaggatagtaaagcggcctacgatgccctgcgcatctatctgctactgaatctggataaagatcacgaagataaatacaacgcggcggagatccagtcgtgggtgattaacgatctggggaacagcgacagcgtggccgggttcggcgggcgcgccgccgtgctgacgcatatcgaagcgctgtttgacggcagccgggtggtgcattcaccgtatgagaaagatgaggcgctgatccgccaggcgcgggcattcctcgacggtcacaccagtaccgagcgtatctacgcgcgggcgctggcggcaatggagagcgaagcgccgcaggagttcacgctggtacgcgccgtcggcgcggatgcgggaacggtctttgtgcgtagcaacggcgcgccgctggatcggggcgtgccgggtatttttacccgtgaaggataccgggagctgttcgacaaacgattaccggaatttgtggcggcggcgacggcgaacgatggctgggtgatgggccgggagagtacgccaaaaaagctgactgacagcctgcgcagccagataccggggcaggagcagtctgtcgcccgcgaagtccgccgtttgtacctgacggaatatgcccgccgctggcaggattttctggacagtatccatagtatcaacagtgccggggaagagggcagttccggcctggcctatgatttacaggtgctgcgcaccctggcgtcgccggactcaccgctgatgcggctgggaaaagcggtggtggagcagaccacgctggtgccgccgccggacccgcaggccagacagaaacaactggcgcagcgcgcatccggtaacgcggggaaagtggtacagacggcaaaactgttccaggatattcacccggaagaacggctggaaaaaacgctggtggatgatcgtttcgccgcgctgcgcgaggtcattgccgggcggacggacggcggacagagcggcggtgggacgatgcagatcgcttcgctgctgaccatgctcaacgagtattacacccaactgaccattgctgatagcgcgctggcggcggggacgttgccagcgcgcattactgccgcagacaagttgcaactggaggcggcgaaactgcccgcgccgctgaaaaacatcctgctggatctgacgaagcagggaacgcgcaaaatcaacgccgggaccggcgacgtgctgaacacccagatggaggcgatgatgggcgacgactgccgtgacgccatcgacgggcgctatccgttcgccgacagtccgcaggaggtcagcgccgaggactttaaccgcatcttcgccagcggcggcgtactggatgctttctggagcaaacaactggctccgctggcggacaccgccagcgacccgtggcgctacaaaccgaccgaaggcaacatgacattgcaggggccggatctgacgccgtttcagcaggcgaagcagatccgcagcgtattttttaacagcgagggcgggaaaaaattttcctggtcgatgcagattagcgtggtggatatggacccggccatcatggaactggtgattgatatcgacggccaggtgctgcgctacgcccatggtccggaccgtcccctgaaagtaacgtggccgggaccgcgcaacggctcgatggcggaaatcaccgccagcccgcgtattcgccaggacacctcaacgctactgaccggcgggccgtgggcgctgtttcatctgctggacgccggaatggtacaggaaacggcggtgcgggggcgtcaactggtggaatatgattttgacggtcgccgggtggtgctggaaatcaccgccgggcgggattttaacccggtcagccgggagctgttgcagaacttcagttgcccggcgagggcgctgtaatgcgccggccagcagtggtatcagccccggcgatgttcggcaggctgccggaccagcgcgactatgtgcgctggcgagtgggcgctgaagagggacgaatatggcaggactggctgaaccgccagacgtgggtgggcagcgggcggcatatcgtgttgccgggaggccagacgaccgatgaagagcgtgacggctggatgcacctgtcgccgcgtggcgaacatgatatgcccgcgccggaacaccatccgctgccgtggagctttgtgatgtcgccgggatttttgccgatgggtgggacgactgactggctgaccggagtgctgatggcgtcacgggatagcgtgggacgcccgtggccgctggtgatttaccagcgctgcggtcgggagtggctggacgagagtttgcaggagacgcagggctggctgtactggctggcgaggctggcggcgcagcatatcacgccggacacgatgcggcgcgggcggctgaccgagcaggtggaccagctatgggcgatgtggcagccggggccgtggtgggcgcagtggctgcgtgggttacgacgtacatcgcaacgcagccgggaactgaccgggctgccggatgaagcaccggtagtagaactgccgggcgtgcgttatctgccgtggccgggctggccgggtaagacgctggggcaggcaacaccggggcaaggctggttctggcagcagaacagtgaagggcggtatgtggatgcgctgcggttggtggatgaaaaaaatagaggtcagatgctgtgaaaaagtacgctgtagaggttctgtttatgtctgcctgtgcaggaatgttcctgcccgtatttgcctggggcggaacagatgtaaacattgataacccgctggcggagtgtgtggatatccatcccgttcatcgtcaggaaatggataaccttaccattctgaaaacaacggtcacactgaaaaaaagcaccggtgaatgtggctgtttctcaacattaatcaactataccagcttactggcgcaggatgttgagggttacggacgcggaagtgcatattcccttcaggaggggaatatctcactggcgaagatgcagggacgttatcctttcagctttgtattatcggtggataaccagtctgtacgggatcagaagctggcgctaatgatacgttgtacaccaccgctgtaatacacagaatagtcagggagaagatgatggcagtaagactgacttttgacgggcaaaagctgacatggcctggtatcgggatatttaaggcgaccacggggttaccggatttacagtggccagataaacagtgtgtgccggatgcggcgataccggaagggaattataaattgtttattcagtttcagggggaggcaccgataagaaatgctgcggattgtgatctgggaccatcatggggctggagtaccattccgcgaggccaggctgccggaacatgtgagatatactgggcgaactggggatataatcgtatccggctggaatcagcggatgagaagacccgaaaagcctgtgggggcaagcggggtggtttttatatccatgattccaccaaaggttacagtcatggttgtattgaagtggaaccggtgtttttccgtattctgaaacaggagacggaaaaagaaaatggtgaaaagacatttacggttaatgttaagtatgtttctggtcagcaaacgaatggtggaacaaaacaataataccgttaaaaccggatgaaattatcgtgtctggacgtgctgtggttgacaatgattacaatggtggccagataagtaatgagcaccaatgataaagtatatgactggcggtgtgctggttattaatcaaatttctataaaatgcaatgcgaatctggtaagcgtaataaaaataaaatcataatattgttatgttcatttccttatttatgtaattcagtatttatgttatgtgctaatttttgtgtttttattttcatggctcttgtcagcaatataccctgttcttctggtaaatatttaaatataacaggctggttgcattataaagtgcggggcactgtttcctgacggtgagtctatttattttaatccggtattaaaggagtcactaccatgagttttgtatccacaaataataaatccggtatgggagggctgacgacaaccacgccgccgataaccggagaaagtggcggtgtcaccgcagattcagtcgccggaagcgtggcagatgcggcggaatccgccgtggaacaggctgcgggatcgctatttggcgcattgccggagccatcaggactggtgaaagccgcggtagcagcggcgcaggctgccgccgccgcaggtatggcgcaggatgcggtatcggccatcgtctctgctgttgcaggcgggccgggggcgcataatgtgacggtcagcggcagcgccgtaccgccgggcgcattactgttcgccagcctggacggcggcgaaacattaagtgaactgttcagctatgtggtacagctaaaaacgcccgacaccctgaatctgggctatgtctccccggcggccaacctgccgctcaaaccgatggtgggcaaagatctgtgcgtcaacatcgaactggatggtggcggtaaacgacatatcagcgggctggtcacggcggcgcgggtggtgggccatgaagggcgttcggttacctatgagctgcgtatggagccgtgggtaaaactgctgacccataccagcgactacaaagcattccagaataaaaccgtggtggatattctggatgaggttctggcggaatatccctacccggtggaaaagcggctggtggaaagctacccggtacgcacctggcaggtgcagtacggtgaaactgattttgattttcttcagcgactgatgcaggagtggggcatctactggtggtttgagcacagcgaggacagccacacgctggtgctggcggatgccatcagcgcccacaaagcatgtccggactcgccgctggtcgagtggcaccaggaagggctgaagctggacaaggagtttatccacactatcacggcaaacgagagcctgcggactggacagtgggtgctggatgatttcgattttacgaagccacgttcattgctggcaaacaccgtggcaaacccgcgtgaaaccggtcatgccacctacgagcattatgagtggccgggagactacttcgacaagagtgaaggcgagatgctgacgcgcattcgtatggaagcgcagcgcagccccggcagtcgggtgctggggggagggaatatccgcacactcatgaccggttataccttcacgctggaaaactatcccaccgccgaagtcaatcaggaatatctgctgatgcagaccttgctgtttgtgcaggacaacgcgcagcacagcgggcaggaccagcactttaccttttccacccgttttgaactgcaccccacccgcgaggtgttccgcccgcagcggacggtgagcaaaccccacaccaaagggccgcagagcgccatcgtcaccggcccggcgggccaggaaatctggacggatcagtacgggcgggtaaaggtacagtttggttgggatcgctacggcaaaatggatgaaaacagctcctgctggatacgcgtcagctacccgtgggcgggcaaaggcttcgggatgatccagatcccgcgtatcggccaggaagtgctggtggatttcaaaaacggcgatccggatctgccgatcatcgtggggcgtacctacaaccaggacaccatgccgccgtggggactgccgggaatggcgtcgcagagcgggatcttcagccactcgctgtatggcgggccaacgaacggcaacatgctgcgttttgacgacaaaacgggcgcggaggaagtgaagttccacgcggaaaaagatctcaacaccacggtgaagaataatgaaacgcatacggttatggtggatcgcactaaaaccattattaaaaatgaaaccaacagtattggtgaggacagaaacaccacggtaacgaagaatgacggcctttccgtaaaactggcgcagacgatcaatatcggcaccacttatcgtttagatgttggcgatcaattcacgcttcgctgcggcaatgcggcgcttgttttacataaggacggctccattgagttttgtggcaagcaactgatgttacataccagcgatgtcatgcaactgattggtaaaggtattgatatgaacccggatggcggcacagccgtaaccgccgatgatattgccccccttctcacctctgagtgatctgaattaaacctggagttctcatggatcgaccataccgcatacaggaagggtgttttgtcctgcctgaaacatttacggatcgcagcgtcaatatttttatcctggagggcaatgaacgaacatcgcccagcctgaatatttcccgcgatacgctaaaacctgatgaagacctgcccgcctatattgaccgccagattgcactgatgaaaaaaaatctcggtcagcaccgggtattgtcgcgagcgcctgcacaggcaggaacgggcaatgatgcccttatgggggaacaaattgccgccacccataaatccgggaaaacggaagtgtaccagcgtcaggccgggtttattgcaacccctggcaaggtactggtcttcaccctgaccagtccccgtccttttgatgataaagcagacctactctggaacacctggctggcaggctttcagccggataaaaacgaataatcacacggaggtgtgaccatgtatgaagcagcccgtgtggatgatcctatctaccacaccagcgcgctcgccgggtttcttatcggcgctatcatcggcatcgccattatcgcgcttgccgcctttgccttctttagctgcggttttcttgccgggctgattctgggttttatggccgatcaaatagcctccggggtattgcaactgggcgaggccatcgggcgctccatccaccacacggcaggaaaaatcctcaccggttcggagaatgtcagcaccaacagtcgcccggcggcgcgcgcggtactgagtacggtgaaatgcgataaccatatcgcagaaaaacgcatcgcccaagggtcggaaaatatctacatcaacagccagcccgccgcccgtaaggatgaccacaccgaatgcgacgcggtgattgaagacggttcgccgaatgtgtttctcggcggcggcacacagacggtactggaaatcagttctgaaattccggactggctgcgcaaggtggtggatgtattgtttgtcgtggcgagtctgctcggcgggctggccggggcgtggcggcaggcggcaaagctggggacgaaatttggcactaaatgtgccgctaagtttatcggcggggagcttgtcgggatggccgtgggtgaggctatcagcgggctgttcagcaatccggtggatgtgaccaccgggcagaaaatcctgctgccggaaacggacttcaccctgcccggtcgcctgccggtcacctgctcgcgtttttacgccagccacctggaaactgtgggactgttgggacggggctggcggctgaactgggaaaccagcctgcgcgatgacgatgaacacatcacgctgaccggcgtacaggggcgggaactgcgttacccgaaaacgatgctgacgcccggccaccagatatttgacccggaagaacagttatacctcagccgcctgcatgacgggcgttacgtgctgcattacaccgatcgcagctattacgtatttggtgattttgacagtgacggcatggcatacctgctgtttatggagacgccgcaccgccagcgcattgtcttcgggcacgaaggaggcagactggtacggatagcctccagcagcgggcatcacctgttactgcaccgcacacagaccccggcaggggagcggctgtcgcgaattgaactggtgcagggcggcacccgtggcaatctggtggagtaccggtatgacgataacggtcaactgaccggcgtggtgaaccgggcgggaacgcaggtgcgtcagtttgcttatgaaaacgggctgatgacggcgcacagcaatgcgacggggttcacctgccgctaccgctggcaggaactcgacggcgcgccgcgcgtgacggagcacgacaccagtgacggcgaacattaccgctttgactatgattttgccgcaggcaccaccaccgtcaccggcaggcagggggagacatggcagtggtggtacgacagggaaacgtatatcaccgcgcaccggacgccgggcggtggaatgtaccgcttcacgtacaacgaagaccacttccctgtcaacattgagctgcccggcggtcgcacggtggcgtatgaatatgacatccagaaccgggtggtgaagacgacagatccggaaggccgggtgacgcagacgcagtggaacggcgagttcgacgaaatcacgcgcacggcgctggacgatgacgctgtctggaaaacgcagtacaacgcccacggccagccagtgcaggagacggacccggaagggcgggtgacgcagtacgcttacgatgaacaggggcagatgtgcagccggacggatgcggcgggcggcacggtggtgacggcgttcgacagccgggggcagatgacgcggtacaccgactgttcagggcgcagcacaggatatgaccacgatgaggacggcaacctgacgcgggtgacggacgcggaagggaaggtggtacgcatcagctacaaccgacttgggttgccggagacggtaaactcaccggggaaacagcaggacaggtatacctggaatgcgctggggctgatgagcagccaccggcgcatcacggggagcgtggagagctggcggtatacgccgcgcggtctgctggcggcgcacacggatgaggagaagcgcgagacgcgctggcagtacacgccggaaggccgggtggcagcgctgaccaacggcaacggggcgcagtaccggttcagtcacgatgcggacggcaggctggtgcgtgaggttcgcccggacggactgagccgtacttttatcctggacgacagcggttatctgacggcgatacagaccacgggcacgcagggcggcgtgcggcgggagacgcagcagcgggatgcgctgggccgtctgttacggacggagaatgaacacggccagcggacgttcagctacaaccggctggaccagataacggcagtgacgctcacgcccacggaggcggggcaacagcagcaccggatgcaggccgacacggtgcgttttgagtatgaccgcagcggctggctgacggcggagcacgcggggaacggtagcatatgttatcagcgcgacgcgctgggcaacccgacggacatcacgctgccggacgggcagcacctgacgcatctgtattacgggagcgggcatctgttacagacggcgctggacggcctgacggtgagcgagtatgagcgcgacagcctgcaccgtcagataatgcgcacgcaggggcagcttgcgacgtacagcggctatgacgacgacgggctgctgagctggcagcgcagtctggcgtccggcagtgcccctgttcttcctggccagcgcccggcgcggcagggctgcgtgacgtcgagggactattactggaacaaccacggcgaggtgggcacgattgacgacggcctgcgtggcagcgtggtgtacagctatgacagaagcggttacctgaccgggcgctcaggtcagatgtatgaccatgaccgttattattacgataaggcgggcaacctgctggataacgaagggcagggagcggtgatgagcaaccggctgccgggctgtggtcgtgaccgttacggctataacgagtggggcgagctgaccacgcggcgcgaccagcaactggagtggaacgcgcaggggcagctgacgcgggtcatcagcggcaacacggagacgcactacggctacgatgcgctggggaggcgaacccgcaaggcgacgtacgggcggcacacgggccatacggcgcggagccggacggactttgtgtgggaggggttcaggctgttgcaggagaacgtgcagcagcagggctggcggacctatctgtacgatgcggaacagccgtacacgccggtggcgagcgtgacggggcggggagaaagcaggcaggtgtggtattaccacacggatgtgacgggcacgccgcaggaggtgacggcggcggacggaacgctggtgtgggcggggtatatcagggggtttggagagaatgcggcggacatcagcaacagcggggcgtactttcaccagccgctgcggctgccggggcagtattttgacgacgagacagggctgcattacaatctgttcagatattatgcaccggagtgtggacggtttgtcagtcaggatccgatcgggctgaggggcgggttaaacctttatcagtatgcgccaaatcctctcaaatatatagacccacttggtttaaccgcgactgttgggcgatggatggggcctgcggaatatcagcaaatgcttgatactgggacagtagtacaaagttcaacagggacaactcatgttgcctaccctgctgatatagatgcttttggtaagcaagcaaaaaatggtgctatgtatgttgaatttgatgtgcctgaaaaatcattagtacctacaaatgaaggatgggcaaaaatagtagggccagattctatcgaagggcgattagctaaacgcaaaggtttgcctgttcctgaaatgccaacagcagaaaacataactgtaaggggcgagaaaattaatggggaagttgaagcaaaatgctaaataaatttaaattgtgggtgagcaaacatactgattatacggtaattcataatgaaaatgatttatcttacagtattattatagattttgaagatgaccggtatatatcaagatttactgtatgggatgacctaagctgtatgtcagaagtaatggatgtggatactggtttatataaattaaacaagagaaacgaattttctacatttgatgaacttctggatatatttgatgattttatgataagtattaaataatagttggccgggtaagaagttaactcttcccggctgttttattatctaacccccatcaatccggagacgcgctaccggtacgatgcgctgggcaggcgggtgagcaaggcgacgtacgggcggcacacgggccatacggcgcggagccggacggactttgtgtgggaggggttcaggctgttgcaggagaacgtgcagcagcagggctggcggacatatctgtacgatgcggaacagccgtacacgccggtggcgagcgtgacgggaaagggagaaagcaggcaggtgtggtattaccacacggacgtgacgggcacgccgcaggaggtgacggcggcggacggaacgctggtgtgggcggggtatatcaaggggtttggagaaaatgcggcggacatcagcaacagcggggcgtactttcaccagccgctgcggctgccggggcagtattttgacgacgagacagggctgcattacaatctgttcagatattatgcaccggagtgtggacggttcgtcagtcaggatccgattgggctggcgggggggctgaatctttaccagtatgcgcctaatccgattagatggatcgatcctttaggacttgctatcctggagcatcaatctaattttgatgcggcaaggagaaccggatttgaaaatgcgggtatgacaaaccctgaggatgtcactttctcgaaagtcgatcccaaaactggtactgttgttgagtttaaaggtccaaatggggctaaagttgcttatgatgcacctcatgcagatatggatgtgacagcagggcatgataaaccacatgttggttggcaatccgcaggaaaaagaggttccggaggagctaatagaggtaatattacttatgatggcccacaacatccgcatcgctctgactctaagggagatgataaatgttaaattcaaatatgtctgaacttagaatcgaactggagaatgcgattaaaaatctcggtattcatgattatcgtgtcgataaacccgaacaaatcgtttctgagataaaagagatatatgttaatggtaatcctagaacctggtggttatcattaaaacatagacaatatgtcttttcttataccgataattctggatataaaaacatatcacaaatagtaagtaaacaactcaatgaaagcaatgtaatcaacaaacatatatttttgattgctgatgaagataatgagcaaatatatgtatataacgttcctcttaactccctgcctgaaattatagaaaattgcagatattttgaatattatgttgcagatcatgaactatcttggcttatatgtgaaaatgatcatggtgatttgattgtatgctcaaccattaagtaaagcgcgagtgctctttagcgatatagttgcccatatttaggcgttactagccgaagatggcgcgattgtctggcaggggaaacagcaattctgaggtcaggaagatagcataacccattaaccgggatagatccgctagacctgaatccagttgatgcgacaggttatagggtttatggttatttgctcctggagcaaataaaccttattacattggtattactaatgatatggtttgacgaagggccgagcattaaagcactggcaggttatcaaaagaaaatggaaggatgctgccatttgatgaaaatgtaatctaatggaaagtcagaggttacgagaaatattatatagagaaatataaaaccagaaccggaaccataggtgaaaaaattccctcaacaaatagagagaataaatataattcatttgatcatgggcgaacagatcccagcgcacaagcatttaaagactcttaaaatagtaagggagttggttccggtggaggaaaatgcggatgagtgattaagaattttggggctgtgataagaagtcgagaacaatgctgcgttttgtgaagcccggagacatattttgttttaaattagatgaagatagatattgttttgggcgaattataacactaatgactgtcggacatctttctgaattatttgatataattaaaaaaccccctggaataacagagttagaaattagtaatgcaaggcgaattattgaaccaattatagtggatacatattctttatttgataagaaattagaaaatggaagtgactggagaattattggtcatcaggttaattacaatccaaaaaatttagatggtatctattttgcacttggaataggtgattcctgtaaaaagaaagactgttacggaaatgattttctcatttcagaaagtgagtggaaaacacttcctaaattatctcctaaagggggttttgatatcaaaaaacggcttgaaattgcctgaaaatgaaaataaaaagccgggaaagatcttttgtcttcccggattttattatttaatccccgttcaccacattatttacccccgccttaatatgcttcatcgactttttcacctgataaagctccttccgtagatccctcacttcgtccgtctctgcaatcaggatcaaacacccctcggagatcttcacggtgacgccgtgcccggtctcaaatcccgcttcttcctgccagtcacccttaaggtgctggctggggatttgtgagtaacaggcggtcatgcaggtttcgctgttgatatggcggacgctgacgccggaggcattcatatttgctgactaaataaattcttatttatccgccggatgctggctgattgtggagctcagggtgagtgagtatgggcgcgacatcctggcaccgcgcctccctctccccggccagccccggccggtgatgagcagccggctgccggggccgtattttgacgatgaaacgggcctgcattaaaatctgttcagatattatgtaccggagtgtggctggttcgtcagtcaggatccaatagggctgaaagggggatggaaccgatatcattctccgctgaatcctattacagatagtgatcctcttggccttattacttgtggtgctgatagaggtgattctggcaagttattaagatgaaaaatggttgaaaataattgcgttagtgaatgctcatttatgcctttacctacaaaaagtaacggatttgcttgctggaattgtgttaacgaatgcaaataaaatcaatgctgttgatgtttttactacaggaataagtatggttaacgataaggatacagctatattaattagtgatttaatgttgagattcggtaaggagcttgatgaatctgttgctgttgttcagtcccgttgtgatgaggatgaatttaatgtatatcgagaaacggttggttttatcatgggtgaaatgcttattaaaataatgaatccattatatgaaaaacatccagaaataaaaccaaaaggattgaaacaaaacatctggaaccggatgaataatgtgtaaaagccggaggggttatcttttcccggctttttattatcaattactcattaactcctgttccgttcttttgcgtttaatcaccggaatatctccggtattgttcagcgccccggaaatgtttttaaccactgttctgcactccgtttattaatgcgggttacgcccatcccttcaatacagccaaagagtccgtgggtatgctgcggcgtgatcacgatgcaatccctcattacccgcaccttgacgggcatcccgttaataaaccccgcctgcggcatccattcaccgtacaaacgaactgaaagtctctcaacgcgtgagtatgtaagtatcccgcataatcgagccattcacatttagagatcatccgacataatcaatctgccaacgcaggagatcgctatgcgtaaagcccgtattactgcgcaccagatcatcgctgtgattagatcagtcgaatccggacggactgttaaagatgtctaccgggaggccggtatttctgaagccaccagggacaactggaggtctggatacggcggcagggatacgcgtggaatcacaaaaggctccaccgtatttactgtctgctcaagctgaattttcgccgtaagggtaaacaacggctgccggtacgcaatccctcgccactggtcacgccggaagcgctgaaccagagctggtctgtgggcgtcgttttcgcacgttcaatgttgttgatgactgtaatcgtgaagcgttgtcgattgaaatcgatctgaatctgccagctctgcgagtggtccgtgtactcgacaggattacagcaaccgcggttatctggccatgctgcgtatggataagggaccggaatttatctcgctggcactggctgaatgggcaaagaaacatgcagtaaagctggcgtttatccagccgggtaagccgaagaaaaacgttttcatcacgcgctttaaccggacataccgtacagaaatactcaattcttatctgttcagaacgctgaatgaggtgtgggaaattacggataaagggttatcagaatataactgcgaacgtccacatgaatcgcggaacaatatgataccgaaggaataccgccaataacgttatctggccggaatcttaaaaatgcatggaactaaaacgggtctatttacaggggcacctgcgatgaatttcgctgcactgaaaagcgataccggatgagagctgcttcaaattaatgtgccatgttcacggggaggttgtgcgacgtttgcataatccagcaagaactgaaaggaaggggagagctttttcatgcctgtataatcagtctggcctgtgtcagtcagctcttagtgttgagactctcgttggagcgttataattgcttttccgtttcggaaaacaagattttccattaaagatcttccctgcgaggaaaagttaactaataattttaccgtcgagttaggagatgtatgtttaaatataaacaatgttgcaacgatgcctgataattatcctctcttcgaagataagtttcccacacccagtgtagtaggtgtcatggtaatgttatcacttgaatgtaaatggaaggtataattgctttttgactggcattctattccaccctgacaacacgatgttaacatcaacactgtttatattggcaataacgcaatttttttcagattaagaggtgctctgatatatagatttttatgacattacttatttgaattggtaacaaataccaataagtacaagctgttattaccagccacggattttttacatacggtaagatttggtatggcgttatgtattctggatgtgctggattattttaatttggtttaaaaaaggtggttattcaaatgaaaagcataaaaaaattgattatcgcaagtgcgttgagcatgatggctgctagttgttatgctggctcatttttgccgaactcagagcaacaaaaatcagtggatattgtgttttcctctccccaagatttaaccgtatcgcttattccagtgtcgggcttaaaggctgggaaaaatgctcctagcgcgaaaattgcgaagcttgtagttaattctactactcttaaagaattcggggtcagggggatttctaacaacgtggtagacagtactggcactgcatggcgtgtagctggtaaaaatactggtaaagagatcggtgtgggcttatcaagtgacagtcttagaagatctgatagcacggaaaaatggaatggggtgaactggatgacctttaatagcaatgacacacttgatattgtcctgacaggaccggcgcagaatgtcacagctgacacgtacccaataactttagacgtagtgggatatcaaccttaatagtaaacaactattagtgtattgtgccttgtttaaggcgcaatacacatcaaatcatctatttttcttttacaatttttgatatgaaaatagttaattttgctgtaatggcggtagctttgttcgccactaattctatggtttcagtatatgccgtcaaccagcaattaaattcagccactaaattattcagcgtgaagctgggggctacacgagtgatttatcacgctggtacggctggagcgacgctctcggtgagcaacccgcagaattaccctattttggttcagtcttcagtcaaagcagcagacaaaagttcgcctgctccctttttggtgatgccgcctctatttcgtttagaagcaaaccagcagagtcaactgcgtattgtccgtactggtggtgacatgccaacggatcgtgagactttacagtgggtctgtataaaggcggtaccacccgaaaatgaaccgtcggatacacaggctaagggcgcgacccttgacctcaatttgtccatcaacgcctgtgataagctgattttccgcccggatgccgtgaaggggacgccggaagatgttgcaggaaatttaagatgggtggagacgggcaacaaacttaaggtggagaaccccaccccgttttacatgaatttagcctctgtcacagtagggggaaagcccattacagggcttgagtatgtccccccctttgctgacaaaacactaaatatgccaggtagtgcccatggtgatatcgagtggagagttattacagactttggtggtgaaagtcatccgttccactacgttcttaaataaatccaggggcttagcggcagaaaatgaagttcaaacaacctgccttgctactgttcatcgcgggagtggttcattgcgcaaatgcgcacacttacacattcgatgcatcaatgttgggcgatgcagcgaaaggggttgatatgtcgctctttaaccagggggtacaacagccagggacttatcgcgtggacgtgatggtgaatggtaaacgtgtcgacacccgtgatgtggtgttcaaattggaaaaggatgggcaaggaacgcctgttctggctccttgtttgacggtcagtcagctttcacgctacggcgtaaaaacggaagattaccctcagttgtggaaagcagcaaagcccccagatgagtgtgcggatctgaccgccattccacaggctaaagcggtactggatatcaataatcagcaactgcaactgagtattccgcagttggcgttgcgtccggaatttaaggggatcgctccagaagatctttgggatgatggtattccggcgtttctgatgaactacagtgcgaggacaacgcagacggattacaaaatggatatggtggggcgtgacaactcttcctgggtacaactgcaaccgggaatcaatataggtgcgtggcgtgtccgcaatgcgaccagctggcagcggagtagtcaactgtcggggaagtggcaggcagcatatacctatgctgagcgtggactgtactcactaaaaagtcgtctgactctggggcaaaagacttcgcagggggagatatttgatagtgtgccatttaccggtgtgatgttggcatcggatgacaacatggtgccctacagtgagcggcagtttgctccggtagtgcgtgggattgcccgcacgcaggctcgggtggaggtcaaacagaatggttacaccatttacaacaccactgtggcgcccggaccgtttgcactgcgggatctgtcggtaacagacagtagtggtgatctgcatgtcaccgtgtgggaggccgatggcagtacacaaatgtttgtggtgccgtatcagaccccggcgatagcactgcaccagggatatttgaagtacagcctgttggcgggccgataccgatcgtcagactctgcaacggataaggcgcagatcgcgcaggctacgttgatgtatggtctgccgtggaatctcactgcatacggcggtatacagagtgcaacgcactatcaagctgcattgcttggtttggggggatctctcgggcggtgggggagtttatctgtcgatggaagcgacacacacagtcagcgtcagggggaggcggtacagcaaggagcctcctggcgactgcgttacagcaaccagctgactgcgacggggacaaatttttttctgacgagatggcagtatgcctcgcagggctataacaccctatccgatgtgctcgacagttatcgacataatggcaaccgtctatggtcgtggcgggaaaatttgcagccgagctcgcgtactaccctgatgttgagtcagtcatgggggaggcatttgggcaatctgagtttaaccggttcccgtaccgactggcgtaatcgccccggtcatgatgacagctacggactgagttggggaacctctatcggagggggctcgctgtcattgaactggaatcaaaacagaacgctgtggcgcaatggcgcgcaccgtaaagagaacataaccagcctgtggttcagtatgccattaagccgctggacggggaataatgtaagtgctagttggcagatgacttcaccatcacacggtggtcagacgcaacaagtgggggtcaacggagaggcattcagtcagcaactggattgggaggtgcgtcagagttaccgtgccgatgccccgccaggtggtggtaataacagcgcattgcacttggcatggaatggggattacggcctgttaggtggtgactatagctacagccgggcgatgcgccagatgggagtcaatatcgcgggaggtatagttatccaccatcatggtgtgacgctggggcaacctttgcaaggctcagtggcgctggttgaagcgccaggggcctcgggggtgccagttggcggctggcctggcgttaagacggattttcgtggcgacaccacagtgggcaacctgaacgtctatcaggagaatacagtcagcctcgatccgtcgcgactaccggatgacgcagaggtcacacaaaccgatgtgcgcgtggtgccaaccgaaggggcggtggtggaagcgaagtttcacactcgcatcggggccagggcactgatgacgctgaaacgggaagatggtagcgccattcctttcggggcgcaggttacagtcaatgggcaggatggcagtgctgctctggtggatactgatagccaggtttatctcactggtttggcggataagggcgaactgacggtgaaatggggagcacagcaatgtcgggttaactaccgcctacctgcccacaagggaatcgcgggcttgtatcaaatgagcggtctctgcagatagccgattctgaaggagagaataatgtggatgaaaatacagcgagtgaaaacggttatctatagcgtaagcttactggtcgctgccagtagcttggtgccgatagcgaacgccgcagaaaaacttcagacaacgctacgtgtaggtacttactttcgggctgggcacgtgccagatgggatggtgcttgcgcaaggctgggtgacttatcacggcagtcacagcgggtttcgggtatggagcgatgagcaaaaggcgggtaacacgcctaccgtattgctgctgagcgggcaacaggatcctcgccatcacattcaggttcgcctggagggcgaggggtggcaaccagatacggtgagtggtcgtggcgccattttaagaaccgctgcagataacgccagtttcagtgtggtcgttgatggcaatcaggaagtgcctgcggacacctggacgctggattttaaggcctgtgcattggcgcaggaggatacgtagccgtctgttccactcatacttcctgtatcagtgaataaggcgaatactgtatatcaggttcgaggatgtattgaaaatttactcaaggcaaatatggttagcaatcttcattgcagaaaaatcaattgctgattgattttaaaatctgaaattcatcttttttgtagggagaggaatattatgtttcgtaaaataatttaacggacactgatgcctttattatttctgttttgtggatttgtttgattcactcttttgtgagcggggctttataagcccctggtataaggtttgtttatctgtcaggtattcatatgtgatatttaagattttatgtttagggggctttttcttgtcccctcaggcgtaaaaataatttattttttacataaaggaataaagcatatgtcttatgcacgacatttaccggtattaatgtatcaccatgtcagtgataaacccggacagataaccttatctccccgtacgttccgggcgcagatgaaatggctggccgaatctggctggaaaaccgttactgctgcagaggtggaagctttttatcatggtgcaagattgcctcgtaaaagcgtcatgctgacctttgatggcggctggctggataactggttgcaggtttttccggtgctgcaggagtttaatctgcatgcgcatctctttcttgtgaccagtttgatcagtgacggaccggtccgtattcctgcaggcgaaccggtgtactctcatgatgagtgtcaaatgctggttaaacaaggccgggctgatgaggtcatgctgcgctggtcagaggtccgggagatgcacctcagtggccttgttgagtttcactcgcacacgcacacccaccgacgctgggaccagaagcctgtgtcccgtaatccgtcggatttgcttcgtgtcgatattcttcttagtcgtaagcggatgagggagatgctgggttattgcagtcagcatctgtgctggcctgagggctggtattgttctgactatattcatgtggctgaagagttggggttcacatacctgtataccacagaaaggcgtatgaacaatccagtcatcggttcacagcgtattggtcgtatcaacgcaaaggagcgaaagaatgtgggctggctgaaacgtcgtctgttttatcacaccacgcccggattttcttcgctgctggcccggcataagggggcacgtcggatagctgactgagccagagaccaggatgaaagtgctgcataccgaatcctcccccatcatcggcgggcaggggttgtaggctatatcccaaatgatggtgctgattttgagcagaaataagataacaccggaggccgtgatagacccggttgcgcagaatctggaggcagcaggtcactggcgcagggcttctacccgctggcttttggttatgggagattttgaatgtacagaggcccagcgggagtggttgttgttgcgccggaattattgccttgcgcagatatcttcccctggcgccagtaaagctggatatcagcgacgtgacgaaatgagaggagcctgcacataggtttgtgttttgagtaagtgtcttatttaaaccgtctgttctgtttcctccgctttcacaaataatgtcgagccgggtgggggactcaagtaagaataatctggcgatgttttgcttgtttccacgggatactttgttaggtgaacgatacaattaatgcgctccagactgcgtcacagaaaaggagaatgcctttgcagaacgggcgcatgacaatgaaccactttattattggtatctggttcggcgacaaccttgacgatcacgtctgagatagggtatttacactgagtggtaaacaggttcaattagtaaccggagatggatgcaaaatcatgatcgattcagatgctattttgcagccaatagattttttattaagatgatatcaaggacattgaggcacacaatgacgtatcagtaagtcgttgatagctcatttgatataagaatttcttttatcaacggaagataatgatggaactgatcaataatcgtggtatgcgagactggatgatatttattaaagtggcggaagtagggaatctttcccgggctgcgcgggaattagatattagcatttctgctgtcagtaaatcgcttagtcgccttgagaattctattgaggttactttacttcggcgcgattcacatcacttagaactgactggagctggtcagacagcctatgcaagcatgaaaaggataacatcttcctttcagtccttgctggatgaattgcgaaatccggataaaattatcagagggagtataaaattttcggctccggctattgtctgtgagtttcttgccaataagtggatatgggaatttacagctagctatccggatacaaaaatctacctggattcacgagagcgtagcgatttttttagtaaatccctggagtttgatgagctggtttttaaaagtggcataatcgaaagtgaggatctcgtgtatcgaaagataagccctttaaagttggttctttgtgcgagtccgaaatatatcagaaaatatggcaggatctcacaccctggcgatttggaaaatcacattattgtgggtcttcacaaccatggtctttccggacctcttactcttttccgtcaggatgaatcatacactattagtggcgctgttaatgttcatttatcttccaataatcttttgagtgttcttaatttggttttagaaggaaagggtatcaacctcatgactccggcctggcttgccaccaaatacttaaaaaataatgaacttgaaattatacttcctgaatggagggttccagatctccccatttatcttgtatggcgtcatcgtcagtattattctcctttatttcaacgctttctgtcttttattgaagataaatggaataatcgcccacaaattgattttctgaatgatgattaacccgtttggaatggttttgatacgttcctgacttaaacccacatgatgactgaattgaggcatcgagatatgcgactggtcagccagtcgtcttttgacgatgcccaatacaaaacatgatgccgactgacggaaatgataatacccggaaacaggacggggctgtttttgggcagccggaagttaagcccataccagaaacgttgcagtgtactgaaaaatggcgccaggttgcacctgttcaaagattttctgaaggcgcaggagtattcattactgatatcctccattgcgccttcgggaacccacaggaccagctattttaccgatagtgtttaaaaggcgtaagtaatgccgagcatgaagtcattggaggcagcctttgtgtctgcatcataagcggtatgttcatcaccagcatagtgattttttgaaatgcttactttgccagcattaatgtatttataactggcgtcaatcataatattatctgttacagcatattttgcaccgatacctgcgccccaggcaaagttattttttgaagcagacagagtttcattaataccaaaaccaacaggaatggtgttattacttagcttcacatgagcgaggccaacgcctgcgctgatatagggagtaaatgccgtactattgtgaaaatcataatagccattaaccatgtaagtggtcattcggacctgattttttacatttatgtgtactggatcaccaaatgcaataatatcctgcccgcctttagcatccgtctcacctctgaaagtggtatccagttctaaacgtactggaagctggaatggatcataaaagtcataaccgatagcaaccccgccgccaaaaacgcctttggtacggtcaggtaacgttgcatgaccattaactatctcatcctggctgaaggttgagttgattccatagacattgactacggatgtccccgctttcccggtgatatagatcccttcttttgctgatgcagtagcggaccaggctaccacaaggggaatgatgcagactgcgaaaaagtttttcatttcagaacctgccttaatattgggctaaaagacaagtttcacggtatagggtgtgatataacgattacataaacgaagcccaaaaaacggtctattgtaacgctgggttttctgtaagcgggtaaaaaatgagatgaagattttaaataacaatacgataatcgtcggtatggaaatccatctcctcgccaaattgccccacgtacggtttcacttctacgttatgtaacgggtagtgtgagatggagcgatgctgtaagaaaaagatgaagatgaatttgtacccgacctggataaagcccgttatcccggaataacgggcaaaaatatttactcaagtgcctgggcgagatcttgttgtacctgttgacgctgttctggtgttaagactttgcttaaatcaaaataatatttaacccgataatagcgagcctgttgttctatgttactgaaggctgcaagctgctgttttacggcggcgtcatcccatttaccggatttaatcacctctatcagcgcaccgtctttaattcccttcatagaaatctgactgacgtcggtttccagttgttggtgaagttttttgatccgggtaatctgatcgtttgtcagcttcagatgctggacaataggatcctgggcgggcaggggaggattggggacagcggtggcgaaagcgccaaaagaaacgcccgccagagtcgctgccagtaaagttgtgcgtacaaagtttttcatgaagatatcctgataagggagtgattaaccgtttttattacccacgaatggcgagcaattatcttagagcctatcccagtagggctattttacttgccattttggacctgggcagtgctcgccaaaacgcgttagcgttttgaacgccgctagcggcggcccgaagggcgagcgtagcgagtcaaacctcacgtactacgtgtacgctccggtttttgcgcgctgtccgtgtccaaactggctgcgccaataacgcctggtgggataggctcttagtcagaatacgttgcctgccacattacgccacgcgaatttgttttacggagagttacggagtgaaacaatcccgccgcggtgagcggcaggttgcttacaaggtgaatggatcggcatcgcgccaggctggaaatttttcgcgatagtcctgcaaggcgacgagagaaagatcggcatcgatacgtgtcgcctggtgtggttcggcggtggcgataatgtcgccctggggattaatgatccggctatcgccgcgataatgtagcccgttaccatcggtgccaacccggttgcagcctgcgacataagcctgattttcaatagcgcgcgccgtcagtaatgtttgccagtgtagcgagcgcggcgcaggccagttcgctacatacagcgccagatcgtaatcattgcggttgcgcgaccatatcggaaagcgcagatcgtaacagatcagcggcagaatgcgccaaccgcgccactgcacgatgatgcgtttatcgcctgcggcataatgttgatgttcatccgccatacgaaacagatggcgcttatcatagagatgaaccttgccttccggttcaaccagtaagaagcgatttacggcgccgcgctcagtttgtagcgccgcgctgccggcaatcagagcgtcagtttgtcgggctttggcctgcatccacgtaatcacgctatcttgcgaaagtgagttattagcggcctccatcgcgaagccggtggtaaacatttcaggcagaacaatcacatcccggccagatacgagctctagctgtctgtcaaaatgacgcaggtttgccgggccgtccatccagactaaaggttgttgcaacagagtaattttcaaaccagacacgatcggagctcctcattgaacagcgtctttacactgtagcatgagcaataataaaaaagcggcaagaaaaagccccgcgaaagcggggcaggaaagacacgagactgattatgcggcttcgactttacgcactttctccggcagctttaccggtttggtcgccagcgcttcaggttcaaaatcatcaacgttgatactgcgcaggcggctctcttccgctttcgccaggatggcggcttcatctttatctataagccctttcgccagcgcattgcgcgccagttcatccagacgagtaaacggcagatttttacccagttctttgcagatgcgctggtggatagggtcggcagcgatgacatcacgcagcgcttcttccagtaaaccgaccggattatgttcggcgggcgtcagatactgaccgcgcccaatgcgtgaacgtgtggcgttcggcacctgtaggatcttcgccacggcgtgatccagcttatcagacggcgccagataatgacggccagtcgggaagatcatcgcggtgagcaatccggccacgacgcggttcgggaagttctgcagcagatcgtccatcgcttgttcagcacgatacagcgcatcctgtacgccccagtgcaccagcggcaggtcggcttcgtggcgaccttcgtcgtcgtaacgcttcagtacggctgaggccagataaagctgactcaacacatcgcccagacgcgcggagatacgctcgcggcgtttcaggctgccgcccagtaccgccattgacacgtcagacagcagcgccaggtttgcgctcagtcggttcagatgctggtaataacgcttcgtggcgtcgccggttggcgtatggctcgttaatccgcgggtcaggccaagccagaaactgcggacggtattgctgccgacatggccgatatgtttaaacaacagcttatcaaaggcattcacatcattattctgcgctgcggccatctcttccagtacataaggatggcagcgaatggcgccctgaccaaagatcatcatgctacgggtcaggatattcgcgccttccacggtgatcgcgataggcgcgccctggtaagcacgcgccaggaagttgctctcgcccagcataatgcctttacccccagtgatatccatcgcgtcgataatggactgctggccacggtgggtgcagtggtacttcacgatagccgacagtaccgccggtttttcacccagcataatgccataggtgattaacgatgcggcggcatccatcacataagcgttacctgcaatacgcgccagcggttcctcaataccttccatcttgccgatagatattttgaactgacgacgaatgtgagcataggcgccggttgccagcgcgacggatttcaccccgccagtggagttggacggcagggtaataccgcgtcctaccgacaaacattccaccagcatacgccagccttgtccggccattttggggccgccgataatataatcaataggcacgaaaatatcgttaccgcgggttggaccattctggaacggaacgttaagcgggaagtgacgacgaccaatttccacacccggcgttgaggtggggatcagggcacaggtaatacccagctcttcttctccgcctaacaatctatccggatcggaaagcttaaacgccaggcccaacacggtagctatcggtgccagcgtaatgtaacgcttgttccaggtcaggcgcatacccagcacctgctggccctgccattcgcccatgcaaaccacgccggtatccggaatggcgcctgcatcagaacctgcttccgggctggtcagcgcaaagcaggggatctcctggccgcgcgccagtcgcggcagatagtgattcttctgctcttccgtaccatagtgctgcaacaactcgccagggccgagtgagtttggaacgccgacggtgatagccagaatcccggagacgccggacagtttttgcagtacacgggactgcgcataagcggagaactccagtccgccgtactcttttttaatgatcatcgcaaaaaaacgatgctctttcagataagcccacagttccggcggcagatccgccagttcatgggtaatctggaaatcgttcgccatccggcacgcttcttctaccggaccgtcgagaaacgcttgctcttcggcagtgagttgcggttgcggatagttgtgcagttttttccagtcaggcttgccctggaacagatcgccttcccaccaggttgtaccggcatcaatcgcttctttctcagtgcgcgacatcggcggcatgaccttacggaagccgcggaacaccggtgcggaaatcattgattttcgcatcggtgtgaggttaaacggcacgaggataatggccagaggaaccaacagccagatggaccacaggccagcgacgccaagtgcggcggtccaggcgagcagaatcaggctgctgagaaataaactcacgcggtgatagaacaatgcgccgagcagaacaaccgtagcgataatactcaaaatcatcataacgaaaagctcccttgcttgtaggaggtctgaccacttgtgatgattaggttgtagtggatgtaaaattttttagcaatgtgtttacaaaataattacaacaaagctcacattgttgccgtttttgggggcacgaaaaatcaaaagcgtgaggcgttaattcggcttatgcttctcgcctgtactgctatccggtacactgcatactgtcatttacattcatgctgaaggatatcctcatgtaccaggatcttattcgtaacgaactgaacgaagcggcggaaacgctggctaattttttaaaagatgacgccaatattcacgccattcagcgcgcggcggtcctgttggctgacagttttaaagcgggtggtaaggtactttcctgcggtaacggcggctcccattgcgatgcgatgcactttgctgaagagctgacaggtcgttatcgtgaaaatcgtccgggctacccggcaattgcgatttctgatgttagccatatatcctgcgtcagtaatgattttggctatgactatattttctctcgttacgttgaggcggtagggcgcgaaggcgatgtcctgttagggatctcgacgtcgggtaactctggtaacgtgattaaagcgattgccgcggcccgtgaaaaaggcatgaaagtgattacgttgaccggcaaagacggcggcaaaatggcgggaacggcggatattgaaattcgcgtaccgcacttcggttatgccgatcgtattcaggaaattcatatcaaagtaattcatattttgattcagttgatcgaaaaagagatggttaaataactatacccgtcatacttcaagctgcaggtgcgttggttgcgctcagaaaccccagtcacagagttatctatgttcctggggatttcctcccttaccgccttcctgcaactcgaattatttagggtatagcatattgttttcttggatattttgagatttgattggctgtaaaaattacgccttcccgcttaaggcgtttgtggaggtgatatatgtgcgaactgcttgggatgagcgccaatgtgccgacggatatctgctttagcttcaccggactggtgcagcgtggcggcggaaccgggccgcataaagacggctggggaattaccttttacgaaggaaagggctgtcgcacgtttaaagatccgcaaccgagctaccattcgccgattgcgaaactggtacagaattacccgatcaagtcctgctcggttatcgcccatatccgtcaggctaatcgcggtgaagtggcgctggaaaatacacacccttttacccgggaattatggggacgcaactggacttatgctcataacggtcagctcaacggttataagtcgctggaaaccggtaattttcgtccggtgggggaaaccgacagcgaaaaagcgttttgctggctattgcataaattaacgcagcgttatccccgcacgccgggcaacatgacggcggtatttaaatatattgcgacactggcgacggtattacgtgaaaaaggcgtttttaacatgctgctgtcagatgggcgatatgtgatggcgttttgctcaacccatttgcactggatcactcgccgggcgccgtttggcgtagccacgctggtggatcaggatatggaaattgatttcagttcacagaccacgccaaatgacgtggttaccgtgattgctacccagccgctaacggggaatgaaacctggcaaaagattatgccaggcgaatgggcgttattttgcctcggagagcgtataatttgaggccagctgtggctgaacgacttcgtgactcaacggtttgctcacgacgtaacgtccatcaacgatagaaacagtcggcggcttatgcgtctgttcaaaataatcgtagccgggttttagctgcgcccagaaatctttgtaatatgaatatttatgacgctgcatattggcgtcggtcatccggaacggataaatactcacctgcacgctcggctgaccaaagaccagcgcggcggtgacaaactggaaaatctcatcaatgccgctgtcggtcatggcatagcagccgacggaaacacaggcgccgtgaatcatcagatatttaccatcatagccatgcgcgcgatcgtaggcattgggaaaaccaatgttgatggccttataaaaacggctgtctggtttgagttgattacgctgaacgctgtaaaacccttccggacttttaaaatcgccctgacggcgtttcgggcctaacccgccggaatagttgcaaattttgtagctatcaagcaactggtattgctcacccattttgacgtagagatcaagggtgcgctcttctttaaaaatctgaatatagaccggtgagcccattaactgctgcttatactctttactgaccggcgtgacggggctgctgctgctcagcaaaccggcaaatgagacgcacggcatcagaagcatcgcaagaaaaaatgcgattttacgcatactgcttgttccttgataaaacggttacacacgccagaacggcaaaagagtccccaaatcggagtaatctggatttggagcgctcacattagcaccacggcagtttttcgcaagtccccgtgtgtacgtttacaattttcccgccgctttcgtcgtcataccttcgaatatgtcgcatttttaacgcgaatgtctctttgcgcgcaataaaacatactgtacacttaaacagtattgtgggggcgagcgatgcgcaaaatcatacatgttgatatggactgtttttttgccgcggtagagatgcgtgataatccggcgttacgcgatatccccattgccattggcgggagtcgtgagcgaagaggcgttatcagtaccgccaactatcctgcgcgccagtttggcgtacgtagcgcgatgccgaccgccatggcgctaaagctgtgcccccatctcaccttactgcctggccgctttgacgcctataaagaggcttcgcggcatgtacgtgacatcttttcccgctacacttcactgattgaaccgctctcgctggatgaagcctggctggatgtgactgacagcccgcactgttatggttcggcaactctgatcgccagggagattcgtcagactattttcaatgaactgcaactcaccgcctccgccggcgttgcgccagtgaaatttctggcgaagatcgcctccgatctcaataaaccgaacggacaatatgttattacgccagccgatgtacccgactttcttaaaacgttgccgttagccaaaattccaggcgtggggaaagtttccgccgccaaactggaaaatatggggttaagaacctgcggggatattcaacagtgcgatctggcgatgcttctcaaacgctttggtaaatttggccgggtattatgggagcgtagtcagggtattgacgagcgtgatgttaacagcgaaaggctgcgtaaatcggtaggtgttgagcgtactctggcggaggatattcatgaatggtcggactgcgaggccattattgaacatttatatccggaactggagcgtcgtctggctatagtaaagcccgatttactgattgcccgacagggcgttaaattaaaatttaatgattttcagcaaaccactcaggaacatgtctggccgcaattaaataaagaagacttaattaccaccgcccgtaaaacctgggacgagcgtcgcggcgagcgcggcgtacggctggtggggctacacgtaacgctgctcgaccctcaactggaacgacagttggtgttagggttataagtcaggccattaatattttatcactattacgattgcgccatctaaatttcagtattactatacccgcgttttctcattctcaataactgcaaaggaggttcatcatgacactttattctctgaacgcactttgcagacctttccaggattaattttcttttattgccctggattagtctgccatttcctgattttttaattcatatatggaatggtatatgggcaattatattcgtcctttatcagatgtggtattttctatcgcatcagataacctgtggatcgaagattccgcgatccaacaattatatacgacggctaagttaaccggtatgaaacgcgttatcgggatgccagatctgcatccggggcgtggctatcctattggcgcagcctttttctcgcgtggacgcttttatccggcgctggtcggcaacgatatcggctgcggcatggcgttatggcaaacggatattttagggcgtaaatataacgccgataaactggagaagcggctggcgtcgctgactgacgtggcggacgcgcagtggctggaggagaatgtccccgccgcaatgcagcatcattcgtggcgctctgcgctgggttccattggcggcggcaatcattttgccgagctgcagcaggtcgatcgcatcgtcgatgctgattcgttcgctttgtcggggttgcaaaaagcgcagttattactgctggtacacagtggttcacgcggtctggggcaaactatcctgcgtcgtcatgtggaggcgttttcgcataacggtttgccggaagatagcgacgatgcgcgccgctaccttgcagaacatgacgatgcgctggcatttgcccgcagtaatcgcgcgctgattgcccgccggatactgcaacagctcagggctgagggcgaaccgcggctggatgtggcgcataacttcgttgaaccctgtactgtcgcgggtgaggcggggtggctgcaccgtaaaggcgctacgccagatgggcagggactggtgattatccccggctcgcgcggcgattatagctggctggtgaaacccgtcgtcagcgaggagagcctcttctccctggcgcatggcgcaaatggatgcgtaccgagtgtaaagaccggttatcggcaaaatttaccccgcgacagctctgccgtaccgggatgggtagccgggtgatttgccgcgatcgccagctcatttatgaagaagcgccgcaggcgtataaatccatcgatagcgttgtggattgtctggcagacgccggactgattacgccagttgcctgcctgcgtccggtgctgacgctgaaaacctcaggggagaaaagcgcatgatcttactgcaactttcttctgcgcagggaccggacgagtgttgtctggcggtaaaaaaagcgctggattgtctgacgaaagaagctgccagagaaaaggtatcgctgacgcgacttgaaacagagccgggacgattaccagacacgctgcgttccgcgctggtctcgctggacggcgaaaaagctatggctttcagtgaacgttggtgcggcacgttactgtggatttgtaccagcccgtatcgtccgcaccatgggcgaaaaaactggtacgtcggcattgggcgcttttccgccgacgagcacatacagtctgatgagattcgtttcgagactttgcgctcttccggcccgggtgggcagcacgttaataaaaccgactcggcagtgcgggccacgcacctggcgagcgggattagcgtgaaggttcagtcggagcgcagtcaacatgcgaataagcgtctggcccggctgctgattgcctggcggctggaacagcaacggcaaaatgagtgtgcggcattgaagtctgaaaggcgtctgttccatcatcagattgagcgcggcaatccgctgcggatatttaaaggaatggcgtttacgccacaataattcggtgttactggcgctgttatagggctgtctggctattcgcgtgtagccgcagcgctatttcagcgcatccaggagagcttatctggcaatggatacccgatattccatattgatagcccgtccagaaatgggacgggcattttagcgctttcttacttcgcaggaatcgctttcagcaattcggtcagcagagtccagtagtggccgacgctttcgatatgtacctgctcatccggagagtgaggtccggtaatggtaggcccaatagaaaccatgtccatatccggatagggtttcttaaacagaccgcattccaggccggcgtggataatctggatgttcggtgtcttgttgaacagacgctgataggtttcccgcaccaggtgcatcaccggcgagttcgcatcgggctgccagccaggatagctgccttttgcttcggttttcgcgccagccagcttgcccagcgaatccagcatactcaccacataatctttaccgctgtcgataagagagcgaatcaggcagtgaatttcgacattcgcatcggacattgtgaccacgccaacgttcagcgatgtttccactacgcctttcgccacgtctgaattgcggatcacgccgttcggcgttgcgttcagcaggcgcacaaaggtatcgcgtgacggcgcggtcaatgcggctttatcactggcaacctcattgagttgcagcgtcaggtttttctctttttccgccagttcgtttttcagaatatcctggtaagcgttcactaatgttttcagcgcgcctacgttgtctgcggcaacggcgagggtagcgaacgcttcgcgcggaatcgcgttacgcagcgtgccgccgttgaaatcgatcagacgcagatccagttcttctgcgtgcccggccagaaaacgcgccagcaatttgttggcattgccaagaccgaggtgaatttcaccaccggagtggccgcctttcaggcctttcagggttagcttaaagcacgcaaatcctgcgggtacagcttcacgggtcaacggcagattagaggtaaaatcaataccgcctgcgcagcccatatagatctcaccttcttcttcagagtcggtgttgatcaggatgtcggcctgcaaccagccggactggaggccgaacgcgccatccatgcccgcttcttcggtcatggtcagcagcacttccagcgggccatggacgacattatcatcagccagtaccgctaacgcagaagccattccaataccattgtcggcgccgagcgtagtaccgcgcgctttaacccattcgccatcaatataaggctggataggatctgtagtgaagtcgtgaacggtgtcgctatttttttgcggcaccatatccagatgcgcctgtaaaacgaccggcttgcgattttccatacctgcagtggcgggcttacggatcagaatattaccgacctggtcgcgatccacgtaaaggcctttctctttggcccaactcacaatatgttccgcgagttgctcttcgtgataggacgggtgaggaatagaacagattttggcaaaaatatcccacaaaggttgtggtgataactgagacagttcagacacgataagtctccttggcggtggtctgaaaaacgttcttacaggccacagggttagcggaattgataactcttacgagatgcgactgagaataccactttctccgcctgcgggtagtataaagcatacaaaaagaggcgtggattccgctaaacactggtttttagcgcgtcaggtctctataatctcgcgcaactatttccccctcgaacactttttaagccgtagataaacaggctgggacacttcacatgagcgaaaaatacgtcgtcacctgggacatgttgcagattcacgcacgcaaactggcgagccgcctcatgccttcagaacaatggaaaggcattattgccgtaagtcgtggcggccttgtaccgggcgcactactggcgcgtgaattgggcattcgtcatgtcgataccgtatgcatctccagctacgatcacgataaccagcgcgaactgaaagtgctgaaacgtgcagaaggcgacggcgaaggctttatcgtcatcgacgatctggtcgataccggcggcaccgccgtcgcgattcgcgaaatgtaccctaaagcgcatttcgtcacgattttcgctaaaccggcgggccgtccgctggttgatgattatgttattgatattcctcagaacacctggattgagcagccctgggatatgggtgtggtatttgtaccgccgatttcaggtcgttaatcagcagcttttcagagcgcccggcaatgccgggcgctgttttattggttacaataagcctctatgagtatccaaggaggctgcacgaatgacacaggctaacctcagcgaaaccctgttcaaaccccgctttaaacatactgaaacgtctacccttgtccgtcggttcaatcgtgggtcgcagccgcccatgcaatccgcgctggacggtaagaacgtcccgcactggtatcgcatgataaaccgcctgatgtggatttggcgcggcgttgacccacgagaaatccttgatgtgcaggcgcgcattgtgatgagcgacgcagagcgaacggatgatgatttatacgatacggtcatcggttaccgcggcggcaactggatttatgagtgggcaaagcaggcgatggactggcagcagaaagcctgtcaggaacaggacgccatgcgcagcggacgctactggcttcatgcctcaacgctctataacattgccgcctacccgcatttgaagggcgatgagctggcggagcaggcgcaggcgttggcgaatcgcgcctatgaagaggccgcgcagcggttgccaggctcgttacgtgaaatggaatttgccgttcctggcggttcgcctgtcaccgcgtttttacatatgccgaaaggggatggcccgtttccgacggtgctcatgtgcggcggcctggacgccatgcaaaccgactattacaccctgtatgaacgctatttcgcgccgcgcggtatcgcgatgttaacgcttgatatgccttcggttggattttcatcaaagtggaaattaacccaggattccagcttgctccatcagcatgtgttaaaagcgcttcctaatgtcccctgggtggatcatacccgtgttgcggcgtttggtttccgttttggcgccaacgttgcggtgcgtctggcctatctggaagcgccgcgtttgaaagcggtggcttgcctggggccggtggtccatgcgctacttagcgatccgcaacgacagagcacggtgccggagatgtatctggatgtgctggccagccgtctgggtatgcatgatgcttcggatgaggcgctgcgtgtggagctcaatcgctattcgttgaaagtacaggggctactgggcagacgttgtcctacgccaatgctttccggcttctggaaaaacgatcccttcagcccggaagaagagtctcgcttaattacaacatcatcttcagacggtaagctgatagagatcccttttaacccggtgtaccgcaattttgaccgcgcgctgcaagaaattaccgactggattaatcatagattgtgttaatagattgataaattctattgatttggtaaaacagttgcttcattaaaggagatcgcaatgacgttaccgagtggacacccgaaaagtagattgatcaagaaatttaccgcgcttggcccctatatccgggaagggcagtgcgaagacaatcgtttttttttcgattgcctggcagtttgcgtcaacgtgaagcccgcgccagagaagcgtgaattttggggctggtggatggagctggaagcacaagagaaacgcttcacttatcgttatcagtttggtttgtttgataaagagggcaactggaccgtagtgccgattaacgaaaccgaagtggtggagcgactggaatacacgctacgcgagtttcatgaaaaactacgcgacctgctgatttctatggagctggcgctggagccgtctgacgatttcaacgacgagccggtaaaactgtcggcataaccctgctgccatgcctgatggcgcagcgccatcaggcacaatgcgacttatcagaactggtaggtcaaccctattgccacaatatcatcgtcattaatgcctaacgtgttatcgctatcaagctgattgattttgtaatctacaaacgcggacatatttttgttgaagtaataggttgcgccaacgtcaatgtaattcaccaaatcctcactgccgacgccctcaatatctttgccttttgacagcacatagcctaatgacggacgcagaccaaaatcaaactgatactggataaccgcttcgaagttttgggttttattggcaaatccgccggaaactggcgtcatgttgcgggtttctgaatagaaggtcgcaatataaatatcattagcgtcatacttaacacccgtagcccaggcttcggctttatcgcccgtaccgcggcgctgcagattttgctccctggtgcgatcggagagagtataagcgccgctgacggcaaaatcgctgccgccgaaatcatagctcacggatgtgccgaagccgtcgccgttttgctttttcacatcgcgatcttcgtttttcccctgatactgtaaggtaagatccagtccatcaacgatgccgaagaaatcggtattgcggtaagtcgccagcccgctggcgcgtttagtcataaaattatcggtctgggcggaagagtcgccgccgaattcgggaaacatatccgtccaggcctcaacatcgtacagcgcgcccaggttacgtccatagtcaaaagaaccgatatcttttaatttcaggccagcaaaggccaggcgggttttttgctgggacgaatcactttcggctttattactggcaaactcagcttcccagcgcccgtagccggtcaattgatcgttaatttgcgtttcgcctttaaaaccaaaacgaacgtagctttgatcgccatctttgctgtcataatcgctcatatagtgcatggctttaacttttccatacacatcaagcttattaccgtttttattgtaaacctcggcggcgtgaacagatgctgatgcgatgatactcaccactattgccagagtgcttttattcatttccattcctgttttaattacgcgctatgatttgtcgggaaacccggtaaaaaacaggaaggtttttaacgttcggtaatgaaagatttatgacaaagtgagaatttttttaaaaaaatatgtttaattgttgcggtaataaaatggtcaaattccgccgctacgcttgctgatcctgcgcaacaaaatttcacgctacgcgtacaggttgttggcaaccggagccagtcctgctaaaacgttcatttggtctttatttcttattttgaacggcagagaatcatgagtgacagccagacgctggtcgtaaaactcggcaccagcgtgctaacaggcggatcgcgccgcctgaaccgtgcccatatcgtagaacttgtccgccagtgcgcgcagttacacgccgcgggacatcgtattgttattgttacctctggcgcgattgccgccggacgtgaacatctcggctacccggaactgccggcaacaattgcctctaaacagcttctggcggcggtagggcaaagccgcttgattcaactgtgggagcagttgttttcaatttacggtatccatatcgggcagatgctgttgacgcgtgcggatatggaagacagagagcgctttctgaacgcccgcgatacgctacgtgcattactggataaccatattgtgccggttatcaatgaaaatgatgccgttgcgacagcggaaattaaagtgggcgacaacgataacctctccgcgctggcggcgatcctggcaggcgcggataaactgctgctgctgaccgatcagcaaggattatttaccgccgatccgcgtagcaatccgcaggcggagcttatcaaagatgtgtatggcgttgacgatgcgctgcgctctatcgcgggagacagcgtttccgggctgggaaccggtggtatgagcactaagcttcaggcggcagacgtggcctgtcgcgcgggtattgatacgattattgcctcaggcagtaaaccgggcgtgatcggcgatgtgatggaggggatttccgtcggcacccgttttcatgcgcaagcctcgccgctggaaaaccgcaaacgttggatcttcggcgcgccgccggcaggtgaaattacggttgatgaaggcgcgaccgcggcaatgctggaacgtggcagttcacttctgccaaaaggcatcaaaagcgtgacgggcaatttctcgcggggggaggtcatcagaatttgtaacctgcaagggcgtgatattgctcatggcgtcagccgttataacagtgatgctctgcggcggatagccggtcaccactctcaacaaatcgatgcgattctgggctatgaatatggcccggtcgctgttcatcgtgatgacatgattactcgataaggaacaggcatatgctggaacaaatgggcattgctgctaaagcggcgtcgtataagctggcgctgctctccagcggcgaaaaaaatcgcgtgctggaaaaaatagccgatgaactggaagcgcaaatggaaagtatcctcagcgcgaacgtacaagatgttgagcaggcgcgagccaatggcctgagcgaagcgatgctggaccgcctggcgctgacccctgcgcgtctgaaagcgattgctgacgatgtgcgccaggtctgtaatctcgccgacccggtcgggcaggtgatcgacggcggtctgctggacagcgggctacgtctggagcgccgccgcgtgccgttgggcgtggttggcgttatctatgaggcgcgtccgaatgttaccgttgatgtggcttctttgtgtctgaaaaccggtaatgcggtgattctacgcggtgggaaggagacgtatcgcacgaatgccgcaaccgttcgtgtcattcagaaggcgctgaaagcttgcggtttaccggaggcggcggttcaggcgattgataatccggaccgttcgctggtcaatgaaatgctgcgtatggataagtacatcgatatgctgatcccgcgcggcggcgcaggcttgcataaactgtgccgcgagcaatccaccattccggtgattaccggcgggattggcgtgtgccatatttttgttgatagcagcgcagacatcgccccggcgctgaagattattgttaacgccaaaacccagcgcccgagcacctgtaacacggtggaaaccttgctggtgcatcaggacatcgcagaacgctttttgcctgcgctgagcaagcagatggcggagagcggcgtaacgttgcatggggatgaaaccgtcatgcaggtactgcatggccctgccaaactggtgccgctgaaaccggaagagctggataacgagtttctgtctctggatctgaacgttgtggtggtcgaaaatatggatggcgctatcgcccacattcgcgaacatggtactcagcactccgatgcgattttaacgtgcgatatgcataatgctgcgcgtttcgtgaacgaagtggattccgctgcggtttatgtcaacgcctctacccgttttaccgacggcgggcagtttgggcttggcgcagaagtggcggtcagcacgcagaaattacatgcccgcggtccgatggggcttgaagcgcttaccacctataagtggatcggctttggcgatggtacgattcgtgcgtaattaatgacgagcggtgcaaaaatagccggttgagtagcaaggctattgacgcaccgcccggttagttttaaccttctaccccgtgattcacccgcgtgaacacacccttctcagggccgatatagctcagttggtagagcagcgcattcgtaatgcgaaggtcgtaggttcgactcctattatcggcaccatctaaatcaatcacttatgtacaacctcatttctcaaaaacaccattttttgctctcgggtacactctcgggtacacaactagcaaaacataagcagtatcccacctaacccaaagatgatttcttgtttaccatgcgccatgagttggcctaccatttgataggctgaatacgtattggaaagattctacattccatcatgttaatgattccgtctcagagctatgtactctgatcctacccgcgtaatatgggcacaaccctaagcgaggttctggttttcaaattgttccggactgagaccgccacaggcactgtgacgacgctaccgattgtaatcacactcactataattaaacactgctgtccgcattatttcccggctgacaaagtcctctccgtggatacattccaccttcagcgtatggaagaagctttccgcacaggcattgtcgtaacaacaacctctggcgctcatacttccccgcagattatggcgtttcagtaagctctgataatccgttgaacagtactgaccgcctctgtctgtatgcacgatgacattttccggacatttacgccgccacagcgccatctgtaacgcatcgcaggcaagctgtgctgtcatccgcgaagacatcgaccagccaatgactgaccgcgaccacagatcgataaccacggccagataaagccagccttcaccagtgcgaagatacgtgatgtcacccacccacttctgattcgggccgctggcgtaaaagtcctgcttcagcagattctctgagactggcagaccatgtttgcggtaactgaccggacggaaccggcgcgaggctttcgcccgcagcccctgccgacgcaggctggccgccacggttttcacgttgaactggtaaccctgagcacgaagctcatccgtcaggcgtggcgcaccatagcgttgttttgcgtcactgaatgcttcccggaagacgttatcacagacaaggtggaaccgctgacgccggtttatctgatgacgacgctgatgccagacgtaccgcttacagatgcaggctatcgccagcgagctaagcgcccggttaaataccccagttgaagtcggtggtgtggaagccaacatggctgtggctggcgcgttaacgacgcctggatgcgacgctccgctggcgatcctcgatttaggcgcaggatccaccgatgccgccattatcaataacgatggcgtagtgaaggcggtacaccttgccggggcggggaatatggtcagcctgttgattcaaacggagcttggcttaagcgatccgtttttggcagaggaaatacccgctggccaaagtggagagcctgttcagcattcgccacgagaacggcgcggtggagttttttcgtgaaccgcttagcccgtcagtatttgccaaagtggtgtatctgaaagagggcgagctgatcccggtcgataaccagacctcgctggagaagattcgtctggtgcgccgtcaggccaaagagaaagtctttgtgaccaactgtctgcgcgcgttacgtcaggtctcgcccggcggctcgattcgcgatatcacttttgtggtgctggtaggtggctcatcgctggattttgaaattccgcagatgatcaccgatgcgctggcgcagtacggcgttgtcgccgggcagggtaatatctgtggtactgaaggcccgcgcaatgcggtagcgaccgggctggttttagccggagaagccaaaaaatagtgcagaaaacagccgcgcaagcgtttagctgcggggtaagtcaaagaaaggcgatgttctctttgatatcccggcggagttgggtacatagtatcaaggtgtctctcacgtggttaattttaaggataagagcatgccaacagcaattgagaaagccttggattttattggtggtatgaacacatcggcgtcagtaccccattcaatggatgaaagtaccgctaagggaattttaaagtatttgcatgatttaggcgtgccagtaagcccggaagttgtggtggcacgaggtgagcaggagggatggaatcctgagttcacgaaaaaagtggccggatgggcagaaaaagtcgcctccggtaaccgcatccttatcaaaaacccagagtatttttcgacctatatgcaggagcagctcaaagaactcgtgtgagctgactatcgaataaaacgctaacggacgtttccatctaaggatggcggcgtccagaagggttgccagtgacagttttggactgccgattcatttcttttcgtcaaattaatgtctatatatttattgaataaatatatagttcataacttactacgttgccattaccgcgtcattcttagatgatctacatttcataaaacacttgattccatttcgtctctattaagaaaaataaaatgtgaacgctgtcaattctgtaaacgtaaaagataaatattgtatacacggatgtttgttggcaaacaggcagatggcaatcaggatcttttacggaacattgtgtatgaaaaataatattgaagagacaataggtaagtacttgcctattttaatgatattacctctggcgggtttggcagagttagcttctttatattcaatccaggctttattaccaaagttaagtgaggtttataatatcccattgaatcaggtagggatgattttatctgctgaggtggggtttctggcattagccatgttatttagcggcacgttatctgaccgttttgggcgaaagccaatcattttttattcgttgctggcaggaggtattttaactctattgtgcgcaactgcatcatcatggccgatgctggtggtataccgcgctttgctcggcattgcagtaagtggtattacggcggccgttacagtctatatcagtgaagaagtctctcctgctttggcagggattgttactggatattttatttttggcaattcgctagggagtatgtctggtcgtgtgtttgcaactttgatgatggagcatgtatctatagatacgattttctttatcttcggtggtgttctgattgctatggcactcgcggtgaagttgtttctcccgacatcccgacagtttgttcctacaccttcactacagcttggtgcagtgttgaaaggcgggttggaacattttaagaatatccgcgtatcattatgttttgtcattggatttattcttttcggctcttttacatccatctttaattttctggcgttttacctgcatcgaccgccttatgagctgagctacacctggataggtttgattccagttagcttctcattaactttttttcttgcgccatatgctgcccgtgtcgcgttgaatattgggtcgatgaatgcgctcagtatgctgatcatctgtatgatggtcggtgcatttcttacgctaatcgccccttctctgtgggttttcatttcaggtatcgttttactgtcagtcgcatttttctctgctcattccaccgtattagcctgggtcagttcacggagtccaaacgcaaaaggacaggcgacatcgttttatctgctttgctactactctggcggtgcagtaatggggtatttaaacgggtatcttttctcctggcagggatggaatgctattgcggcatcatgtctgatgatgctggggataggattatttatctgccggtttattttcgcaaaatatgagaaacaaccgcaaatcaaaaaacagtcagttcaggagagtttctgattatagacacgaagtgtgtttttatactttccataatggaatcatcattttttcattaatgtgtcactatagctaaaagcttaaattgtgaatatttggctacccggatattcgttgctccaggaatatatatgtctgctaaaacgctgtatgaaaaattagttgagtcacataccattcgtgaacttgataacgaaggacatgttttactttatattgatcgttcaatactgaatgaatataccagcccgcaggcatttagcgggttaagagaacgcggccgcaccgttcggcaccccgacacgtttttattgaatattgaccatgttaatcctacgcggtcgcaacgggatgacttaatgaccgatccgggaggacagctacaggttgattactttcgggaaaatgccgctgactttggcatcacattatttgatgtgctggatccgcgtcaggggattgaacacgtggttgctcatgaacaagggctagtgatgcctggcatggtgatcgccgccggggatagtcacacgacaacctacggtgcatttggcgcgctgggctttggtatcgggacgtcggaaattgaacatctgctggccacgcagacgctggtttaccgcaagctcaaaaccatgcgcgtaagtgttcagggagagctacctttcgcctgttccgcaaaagatattgttcttgaattgcttgaacgtattggcgctgatggcgcgacgggatatgccattgaatttgtgggtgaggccatcagcgcgttgagcgttgaaggacgaatgacgctctgcaacatggcggtagaagcgggggcgcgtggtgccattattgcgccggataaaaaggtttttgactatatctacggtaaaccgcaaatgcctgtaggtgaactctggcagcaggcattgctggaatggtcacagttgagcagcgatgctgatgcggtatttgataagacggtggcgatcaactgccatgatcttgagcctaaagtcacctggggaatcagtccggatcaaacaggttccatcaccggacgtgttcctttcccggaacaggaaaccaatccgcttaagcgcctggcgcttgagaaggcccttcattacatgggattaacggctggcatgttgctgaaagatattcgtatctctcacgcttttattggttcatgcacaaatggtcgcattgaggatttgcgtgccgttgcgaaggtgcttgaagggcgcaaaatcgccagccatgttcgcgggatcattgtgcctggttcaacaatggtaagacgccaggcggaagaagaaggactggcgaaaatctttattgctgccggttttgaatggcggcagtcgggttgctcaatgtgccttgcgatgaatgaagatgtattgtcgcccggcgatcgctgtgcatcaggtacgaaccgtaacttccctggacgacagggcgctggagcaagaacgcatttgatgagcccggcgatggttgcggcggcggcggtagcggggcatctggtcgatgttcggtcattacttcaggcaggggaataagatggatacgtttaagcaaatcagcgggcgaattgcgccgatgctggaaccgaatatcgacactgatgtgattatgccaaaacagttcctgaaagggatcgatcgccaggggctggataaaggggtgtttttcgatcgtcgctttatggctggcggccaaccaaatcctgattttattctgaacatgccgggctggcagagcgcgacattcctgctggttggccccaattttggctgtggatcgagtcgtgaacacgccgtatggggattaaaacaactgggagtacgggggctgataggtagcacatttgcaggcattttcgatgataactgccaacgcaacgggatcctcacggtctcattagatgaacctgctttggcgcgcctggcgcagcttgccgcgagtgctgataccaattctatcactgtttcactcgatcgctgcgaaattacgacggcagaggaaacgatctcctttgtgatcagtgaactcaaacgggcgatgctggccgcaggcgaagatgcgatagcctggacattgcaatacttgccggagattgaaaattttgaggttgcgcattattcacggcggccgtggctaaaacgccctgcatccccgcgcggttaaggaagaagactgcaatgaaactggttcaatatcttgtgaacggtggcaaacgctacggcattatgcaggaaaccggaataattgatctctcgcagcggcttggcgacaaatatcccactttgaaatctctcctgtgcgctaatgcgctgacggatgcggcgttatggtgtgatgagccggcggattattactaccaggaagtcacttttctgccggtgattgacgatccgcagaagatcatctgtgtcggaatgaattatgccgataagcgtattgagtttaatgaaaccaacccggccccaaccctttttgtccgctttgcggattctcagaccgggcataatggcctgctgctgaagcctgaaaataccaatgagttcgactacgaaggtgaattagccgtagtgattgggcggcgatgctcccgggtcagcgctgaggatgctttagattatgtcgccggatacagctgctatatggatggttcagtgagggactggcagcatagctggtttacggctggaaaaaactggccttcgacaggatcattcggtccgtgtctggtgaccacagacgacattcccgatccccagatgctacgtttactgacacgactaaacgggcgggaggtgcagaacgaatctacggcaaatatgatccatcctatcgcttcactcattgcttatataagcacatttactctgctttcccctggcgacacgatcctcacagggtcgcctggtggagtgggcaaaaaacgcgttccaccgctgtttttacacgatggtgatgttattgaagttgagattgaacatattggaaccctgcgcaatgtcgtccgggatagccgttatttaacatcctctgttagctggcatgacgggagaaagtgatgagtacactgattgaatgcggcgcctctccgtttattccggggtttgcgctcaaggatgttcgtctggaaaatggtctgacggtaagagtggctatcggaggcagcggttcacctttggtactgctacatgggcatccgcagaatcatacaacatggcggaaagtcgcaccgacattggcgcaaaatcatacagtcattttgccggatttgcgtggctatggcgacagcgataaaccaacgagcgatccggcgcaccgtacctattcaaagcgcaccatggcgcaggatatcgtcatgttaatggatgcgctcggcttttcccgttttgcctttgtagggcatgatcgtggcggacgcgtaggacacaggctcgcgctggattatccggatcgtgtgacctgttgtacttttatcgacattgctccaaccgcgacgatgtacgccttgaccgataaatcctttgctacgcgttacttttggtggtttttcctgattcaacctttcccgttacccgaaacgatgattgcgcacgatccggcattttttctgcgtaagcatatttctggccagctaaaaatagagggcgcgacctcgcaggaagcattcaatgaatacctgcgctgttaccagaaccctgagatgatccacgcgatctgtgaggactaccgggctgctgcgacgattgatttggacgatgatgccgcagatacgtcggcgcgtatccggtgtccgttacagttgctgtggggagggctgggaacggtagggcaactatataatgtggttggtacctggaaagaaaaggcgctaaacgttcagggggaagcattgccttgcggacactccccgcaggaagagtgtcctgagtactttatccagaaacttcagtcctttttacattcagtgttataactcggtcatcctttgcaacttcgcactgatgctatgaaaacgacacctgtaggaaaaaaacatcgccagccccttgagggctggccttctgttgaagatcttttcgtttttgtcaccgttgctcgcaacggtggatttgcccgggcagcgctggagctggggttatctccctcctatatcagcaaacgtatcgctatccttgaaaaatgtctcaacgcccggcttttttttcgaaataacagagtgatgcgtctcacaccggaaggcgaaaatgcgctgggtggggctatgcaggtcgtcagtgaaatggatggctttgtcagtcgtttggataatcaacgtggtgtgttggctggtaatatcaccatcaactgctcatttggttttgggcataaatatgtcgcagaggcgctgtcgtcatttatgatcgcctatcctgatattacggtaaaactcacgctaacggatcgtgaagtggatctggtggaagaggggatcgatattgaaattcgcgttggggatgatatcaacgaattgtatatcgcacggcagttagccactaatcgacggatcctgtgtgcttcccctgaatacctcgaacgccacggcaagccagagtctgttagtgcgcttgtgcagcacgattgcctaatgattcaggaaaaaaactcggcatttggcaattggatattaacggacggtaagcagcagacacattgccgactaaacggttttcattcttccaacagcggcagtgtggtgcttatttgggccctgaaaggccatggcattacattgcggtcggaatgggatgttgcgcagtatattgaacgaggtgagctggttcgcgtgttgcctcagtggtatcaggaagcgaatatctgggctgtatatacccggcgttcatcaagttctgatcgtatcaaaatctgcatcgatttcctcacggagcatcttgcacaatgcttgccaggcggtaaagcaccgggcgtactgtgatcagtcggcgccaactgtcgtggcgccagatgctctgacttacgtttactgttaggtgttctttttgccagcacccagtagcttttagggcgttgcgttggtggcgcggttttgtttccgctatcgtggcgaagttatcttttatcccaccacgaggcccaacctccacatagatacctccattattaccggatttctcacctggttttaacgtcatattttatctcctgatttttgggtgacgattatcggaggttgagaattctattggtatcggctggatggcattgtaagtatcacacactcactccataacaatcagattgattgagcgactactttagctcaatagatatgtgttcatcttaagcgtattatcgcaggttggtaattaaaattctttaaaaaacaataccatccatcaattcaatatgctgatttttcgaggttttctcaaatttagttatgcttatgtaatgctacctaactgactaaaagtaatgctcttttcacacaaaagccttaacagaggaaacgcaatattacgtgacttaatgcctctgctcattctcattagttataccaatgtaatgttttctcacagcaaaagagaagtagctacctgtgcagcattataggcggaaaatccattgggggtattaccaaagatgaaatagaaaattaatattattaattaaatgaatatgaaacaggtattgttcctgttatcgttacaaccttttctgtcataacaatcttctcattttctttctcgcatacttgctgagcatggtataaatgtctatgaggacgtcagctcggaaagcattcgttctgcatggtatgcctttcgctattctcaggggcgtgaaatgaaagttttctttgatggagtctatataactatatgaaattgataataatcctccttctcgcgctattcccgttatgttcatctgccagcaatcattatgcccttgtttttgaaaataacacgatactgcttgttttaaatcttaaatgttctccctgtgatttaaactgcgcaaatattcaataccagattttcaataaagagacggagtctgttatttcaggggttgctaagcctgtgacaacgggcatcgaaaataattttcgtggttatatgatgcgtaataataatacgttctacacattaattgaatcagataatgaaaacgtatgggatatgtctgttgaggagaagggaactcaacagaacaaagatgccgtgcaaaaagtaaaatatcagcttaatgctatttttgacaatggtacatgctgagtctggcttgcctcagggatacgatcgtatccctgaatatttcccatcaaaactcaggagtaaaatcattctcactaatatatttttccagtatggcggtatattgtcgccagttcccggagtcactgattactgcataatttatcgatgctcccggcgttggcgagcgtgttagcggcacatcacgtgctgttttcggcgcaaccatgatatcgccgatactttttttgtcatccgtcgttagtgttaaactcatataccacgaggtggggttaactatccgtatagtattctctttagcaataaagcgtaattttttctcctccgcttccgtgggcgcttttagcccagtcgggcgaattaaaatttttagcctcaaacgaagcggtaacaccagttttcgcgggtggtttttaatgtcctgggtgactggcggtatctgataaatgtttagccagaagagactctcccggtccgttgccagctgctggcgggaactcaggagcaggcgaagcgttctcagttctcctggctgcattttaaataccggcggcagcgccaccagcggcgttttgctgttatccggagaggcgtcaatgtttccggcgtcggtccatacctgtaacagcatcggcgttgtattatcgttggataatgtcaacgattgagcgacctcatctgaagcaaaaataattcgggttctgtcaatattaacggcagcttgtgccgggccataccatcccgtcaacccaagtagcgttaatatgactttactgaaaactaaccactgcctgtaattgcgcattcacgcttcctgccgttactgtttgtccgccgatcgcctcaagcgaggcagtaaaatcaccgctgtaggtttctactgaaccggatgatacccgtgtggttaaatctttatagccataccagcctcgggcgttgccagtgcctgtcttgatccgatcgggtaacaggttaattggcgtaccggcatcgttatagatgcggatacccactccggaagctacgccaggttcgccataatgggtgtccagtagccacgacagaccgcctgcggatgtggttagccccaagcgacgcgccgccgccacggcggtgggttgattaacgacaaaccccattgcgacattagcggcgctggtggacgggagggcactggacacggcaccggactcacattccaggctgacgtggaaaggcgcctggctattgcctccggcggctaatatgccgacggcgacagggggaattttcacgatcgcaggataatctgtgattttacataacgcgccgcgaacataggtgacgctattatatgtactccatgccccgggccaatagctgggccagccataataatcgctggcatgatccagtcccgctttgatccgctcggtaatcaagcctgggcctttaaacgcgatataaccccgaggctgcgtccaggtatctcggtccattggattctggtaggcaaaatattttcttgagtcaattttaaacatctcatatagcacgttgctaaacgcgctggcaggaatataaatatatttgtcatcctgaaaccaactgtctgcggtaagttggcgttctttccagaaacggctgtaatattcgccggtactgaggtttgtcatacggacagcaacattacgctccacatcataataggcgccttctacttcgggagtaaaaaatgcccccgcaaaagcgctatcgccatttgtcgaatacatctcatagagcttcccggcatcggcagtatcgcagcggtaaagtacctgtttactggaatagggcgtgccggtggcggccgtcaggaagttaccgatcccactggccaatagcgtgccggagggttgaaatgtttcactattactgacgctaatcaccgttggcaaaccgatattaccggtatttgtgtcagttgcgccgatccagttttgcgccgtgtagcccgcttttatcgccgcgtcagagagcgcgctcttatcggtgactttgatacatgacgaccatgttccggcgctgacaaacaggctggtgataaacaatagcgttcggaaactaaaaagcattgtgctattccttctcgcagattttgttcagatagagaaacggttctttggtgtgaagatcgagttggtaggcaacccggcaacgctggtttgcccctgttccccagcgcaccagtagagaacccgacggatgggcgatacgggcataaatctgcccactctggccgaccatgccgatgtttgtgccttcaccgttgaaaacatcagcgcccattggcggtatgccgccatccggcatcttcacggagatcagcactgctttgccgctgatagtggcgaaattgacacgcgcgatggcgccagcatacggcacaatctgctgacttcctcccgtcagttcggcatcgctgcgcatcttacgggtatcgagcgtaacgttattgacgcggtaaggagataacgaaggcagaatggcgtaaccaaagcgatcaaccacagcgccctggccattttgtacgatcgcgccctgcgcgccatcggcatgaataagcgcaaaggtatcgctggtataggggccagccgtcagaccgccagggtgaagaaccagggtgccggacgcgcccagcccttcctgacgatagttatcaccctggtcatagttggcgcgaagtgcgccaaaccgggtgttttgttgtagattaccgccaaacgtcgttggcgcgctgctatcactattgctattgcgataacgctcgtagccgccataaaccgaccatgacaggtcgctgttttcaccgctactgccggtcatggatacggttgaggaacgactttgactggactggttataattcatggcgacagacgttctgttttcgccccaatccagcggtatagagacattaaacgacattgtggtttcggtatatttttgtcggctactcacgtccagtggttcgttaacgccgtgataaaagcgatcgtaatcccaggtggtgcgctgtcgtgcgatattcaccccgtagcttatattccgccactggttgctatatcccatttgtagctgtgttatacgcgattggttattgtagtagtctgcggtgctggcgctgaggttaagcgtgccaagccgtcctaacggctggcttaccgtcgcggacaggcgattgcgctgatgcagcgtgtcggagtagtaatcaatccccgtttttgcttcccggcgtacgccgagcacgtcctgaagatcgcgaaagccgttggttgaataacgataagccgccagtaccaggttagtgccggtggtaaacgttttgctgtaactgagttccgcgcgccagccttgttggcgatcgttatgctctgcgcgcgcattcgaccaggtggcgttaaggccgaacgcgcccataccggtggcccagacgccgcccgccagccatgcctggtaacgctgcgcaattcgtgaaccgaggttgagggtaatggtgttattaacgccgtgctggaacgttccctcaaagaaacgattttcaatatcgtagtactgacgaaccctgccgaaggccagcgaatagtgccagttaccggggcgaaccgaatccggcacggaagaataaggcacggtgaaacgtgaggttttaccgctggcctcgataacctctacctccagatcgccttgataacgggtgttgtacagatcgtcaatataaaatgggcccggcggaacgttggtttcataaatcactttccccagttgttttactaccacgtgcgcgctactggccgctacgccccgaacttccggcgcataaccgcgtttgccctgcgggcgcatccgctcgtcggtgacaagtttagccccgttaaaagacagactgccgaataagctggagtccgtatagctatcgcccagcgacagaatactgttaacagacgcgacaggtctttgcacccaggttcgaacgctattatagcgccaggcgcttccgctctggttgctattggcatagcgcagattactttgatgacggacctgccaaagtccgaggttaacgcccatgtttaaaccgctccataagtattggtagcgataatggctgtcggtattttcggtgtgggtccagtttgtgttatggcgtaaaaacagcgccagcgcgccgctatcccactctgaaggagagatataaccgcgcggtttgtgcgtaagttcggtcattggaatcgtcagcaacaggcgaagcgtggcgctatcaaattgccaaccggcatgaggcacccactccctgagcgggcgacactcggtcgcagcgtcggtcgcggggagtgattttatctgtgccgctttcatcaccgataagggcaggcagggttcagtctgttgaccctcttttacagcattaaatcgaatattagtgctcgaggttaccagcgtgccattaacgtaaacgtcggcaagatagtctccggaaggcgtttgccgttcattaaaacgggcaatattttgtccgtaagtggccccctgaagtagcgcaggatcaaaataatactcttcaccttgcgcggagcctgagcaaactatggcgatcaatagcgcaaggcttttgcggttcaaattaatggtgggggacatcgtagctctcgcttatccttgcgcccaggtcgttaaccaaagtaacggtgactgtaccggagaaggatttgagtgaccgtttgcccggcagccaccaggtttgactggagaaaggggcaatcatgtcagcatccaggttatacgaagcgccgttcacttttacattcaggttacttaaagaggcaaaccagggctgcggattaacaataacaataccgctttttccggaacccttatttaccgttttaatctgtagttttttcgccagattatcaggtttacctagcccgtcaggacgatagaaaagttttattcttgagcgcagcatcaccaacattttattttgcccgctgtcgctgccaatattcgttggtggtacctgtaatacgttaaaccagaatactgactcacgatcctgcggcaattttttcgtgttgttataaattacgcgtacaacctggcctgctttgggttgaatacgaaataccggcggcgtggcaatcaatggcatcgcgctgctattttccgggctggtattcatatcgccatcgtcaaaccaggtttgtacgatataaggtattgcatcattattttttaactgcacatctacggaggaggctgttgatgggtaaattattcggctacccaaaatagtaacgctcgcccacgatgctgtggcgggtagggccaggaatagaaaaactattaagtaatataatgcggaatgtcgggtatccattttcatctcaacaactccctagcgattgaaaatggtctggcgtttcaacgccagaccgtagcgacaattatttatacgaaacggcgtattgaagggtggcagcgactgtcccagcctctgctttcccggtagagtaataccgcgcggtataagtcgcgctcgcttcagaagcatttggttccagctgtaggtcgccgtcgccagtaaagccgccggtcagattgattggctcccctgaagtgtcgagtaattggacttcaacatttttcgcgctgccagtattacccaggttaccgttactggtgacctgattaccgacaaagacagtggaaatttttgttgttttgtcctgagagccggtacacccggacagcccaatatcaaacgttattggccccgcggttttcccttgttctgataaatctttagtacttactgttggtaataacacgacgggtttagcctgattaccattaataacgacagagcatgtttcatcagagacttccccttgaaaggtgatggtgttatcagaaacagccatcgcgctgctggagacaagaagtgagcctgtgatcattgctaaatattttttcatagacatatgataatgttcctgtattaatctttactttttcaggacgagtgcaattcgcccgaatgtttcgtgcttatggaggagtggtaaaaataacgatcattaactctatttttggatgtgagctataccctcctgactattgataatgcgatataaaacaaacagacttatttctcttatcatgaaatagagcgataagcgctttcgtccatacatctcattagtacaactgatagtgttatcatttgattgagtgtaatccgataacaattctctccgcatctgaatagatagactatgttgcaatacaaacctgcacatttttgctatgtaaaatccgtatcagttaaacctcccgatggataatacgatggtgagattaaggtaaattttctgaaatgtgcttctgaaacagtataattagtcttacttttttcttacttttggcctttcagaagtttcctgagtttgcgttaaggtaaagaaaagtgttcagatttacctataactgtttgatttgtaatgtgtaggtaatacttgtgtcaattattgtttactataagtgagacttataagttaaactcaggttaattagggggctgaattcttttttgagcatgataatatgtcgtctgaatgatggatgcagttacctttaggattgtcatgaatgaaactatatttttacttgataagcgtgttgtatttgatagtacgaagatgaccttatcgcatggtaatgagataatcagaatatcagaagctgagacccatctgcttcttgctttttggcatggtctttacaaaaaagaagatattattcattttgtttgggaaaatcgtggaggctgcgtctcagaatcaagttactataaactcattaatcaaatgagaaatgattttagtagcattggtctacagtcatctgacatcgtaactcgccctcgggtgggggtatcgctgtctgttgccattgaacctataaaaaaaatcacctccctaaaggtgagtgatgaaaacgttaaaggcaccacgactcgggagaacatattttacaaaaataaacgtcacagcgtatttgtggtattaacaggagccattcttctggcattgctctatggtgtatttactatatataaagcgcctgttcgtaacagccctgatagtttttttacatatcttggcgaatataacgattatgcaatctataaaacaaaagaggataaggtcacattaagtgaagtagtttttgcttttaactctctaaaaattaaaatttaccggcaaaatggacgccatctttattatatcagggagcctaatatgaatatttttctgcaatgcttaaatcctgttgaaatggcggtgccaaaatgtattacagtaaaagaacgttactgattatatttgtaatatttatcgccattgtcgcaatcggatcgataatagcgcttgagtgggtaaatcgtgactcttatagaaccaataatcttatatgcacgacaaaatcagaagcgtatattgcgccacgaaaattgtacatggatggtggacttgtgctggatcttaaatccggcaggattaccctacactacgatgttactaccgatacgaaagagaaacggctttttttcgtgatatctgcatcagcaaactgcgcagaacgggtatgaaaacatttacttttaaagtcaattcagttaagacttttgagtctgatactgctggcgatttgttttcctggttgagactgttacagcctggtacgattaatgagttaaagatggtcaaaattgggaaaaatacctacatgttttcgcttaatcgacatttgtataatgtgtgtaccaccagtagtaacgttgagttgtagccaataatccctgtattgatgggaattcgttccgtgatttatgcctcatcaggcagcgaacctggtatcaggctaacatattgaatttagatatctgctatcgcttattctaacgatagtatcctgcacctgttgggtattgatattttcttgtctattttcggcacagggagtgccatcttgctatcattaagaacgtataacctatctctcaatattgcttttctatattaatgttactttagttatcctatcaaagcgtacagtggcaaaaggaaggccggtaagagggcaatgatttgaaagtaagaaagctatttctgatgttgtttattgccgttccactgatcgtaatgatattggtggggttactcgcgggtatcttccagctaaaacgagatatcgccgtcagcgccaatacgctgctgcggtttagcgcggatatatccgccgcctcctggcaagtcgccggaaaagccgccagactggctgagagttcctgcactgacacgctgaaagaactgtccagaacgcgggccttcactccttatgtccgtgacattggatttctggaaaatggtgatatcacttgctcctttgtcacaggaaccgaacgctatcatttttcccggctggcagggctttctttacctgcttcttatccggaacggtggttgcgatctatcggtagtatggccgaaggacccgatcgccttgttgtggtgtatgtgaaaaaagtagcagcggataaagcggctttcgtcattgtggattcgcagtatgtccaggagctcatggagatattggctgcagaaagagcatcagcctttagcctgacattcggcgcaggagaggcgattaccagcgctgcgaagttgcgcggtaaggcgtttttaacgcagcggttcacctcaaccgatcacactatccagctgatggtgcgaacccctttctcaacgttatcggcatactggttacaaaacctttttatttttattccgctgtcattgtgtctttctgtagggatgatgttgttctacaggcgctggtatttaaaacgcttatctctggcccgggagattgccaggggaataacgcacaatgaatttacggtacattatcaacctgtttttaatgttaaacacggtagttgcggcggcgtggaggcgctaatgcgctggccgcaaccggatggccgttttataactcccgatatttttattaccgccgcagaaaatgaaggcatgattattccactctctcgtcatctgttcgaactgattgctcatgacgtgataaactggactgtaccggatgatttctatatcagcgtaaatatatcgcctgcgcatcttatggatgacggttttatacaagatatagaggcgctcaggactcgtttgggaacgataacgcttatgttggagctcaccgaacgtagcctgattgtagaaccttcacaggtcgcagaaaaactttcaacgctccgtgaaaaaggcgtgttaatagcgattgatgattttgggaccggctattgctccctctcctatctccagcaattacctgtagactctcttaaaatagacagaacgtttatcgataccattgataccagcagcgatgatgttcctgtcctggatactatcattacgctgagtcagcgactgggactcaatgtggttgccgaaggggtcagtacccagcaccaattgcgttacatcttaagccacggggtaggattcgttcagggatttctttatgccaggccgatggggactaatgactttatgagttggcttggcaagtcagcccagcggcaaaatggtttgctcaagggggaaagcggatccgcgagcgatctggtggctgaataatgcaggaactcgctacggaaaaaaattcaatagcacgatatatcctggtaatatgtttatgccgtgaagaaacgtgatagcactggggcggatatttttatgagtcagaacaattatctgattgacaaaagggttattcttgattgtgaacgaatgacgctttcctgcgccggagagtcgataacgatatctgaatcggaacgcagtttgcttatcgctttttatgaaggcctttttaaaaaagatgatttaattaactatgtctgggggcgcaaaggtgtcgtggtctctgatgccagttattataaattgattaaccagctacgagggtcatttgataaaattggtcttaagggggcgtctgttgtgactcgccctcgcgtgggtgttttactctcagtttccattgaaccgttgagtgatgaggcgcaaaatacgccgttgcctgctgttgctgaaacagaagtatcgacggttgaagtgcggcacgatgacactattattaccccaacaccgggcgctgtgaataaaaaagattggctctacttttgcctggccgcgcttctgatgttttttatgatgtataaagttaagggtgaaaatattgattactttaccctccagggttcgtatgatggatacactttttatagtgtcgggcatgataaaacccatctgacggatatcgttgaagcgtactctgagatgagtaatgaaatacataaacaaaacggaaaaatcatttattacattcgtgtgcctaacacaaatatttttgtccagtgtcttaaccaacttgatatagcggagccgaaatgcatttccataaaagaacgttattaagcgtggcgacgcttggtatgctggctgtttcagtcgtactgatggtagtttgggtacgaaacagtaaccatagttctattaatactaatgaatttttatgtacgacaagaacggtaacgacgatacagcctaaagatatccatgccgatggcagtcttgttcttgattttaagatgaagagaattacgtttcaatatgaaataaaaacaaaagataacggtgtaaaaatattataccgggacgtgtatatgaaaaatttacatcgaacagcgcctggtgtttatacgttcgaagtatcccaggtaaaagtctttgccacggatacggctggcgagctgttatcacatttacgggttttgcatccggaagcggctaatgagattcgaatatctaaagtgggtgagaaaacctttttctattctcttaatcggcagctttataacgtttgtaccgcgcagtagatctgaatgttgtctgaatgcgtcagaaagcgagttgcgaaattgccctccgcaagggtaaaggttaactcgaacaccagttaaagagcataaaaacaatgagttatgaattttttactcttcatggaggtaactgatactcgctgataacctctcgcagtccgcctgacggatgcgatgccaggatcgggtctgaagcaaccatgaatccgccattaataaaaaagtaagaactctgtaagactgatttcatatccattatcgaatatatcaggttatattacctccgcagttggcatgactggtaataagcgcattaggtgctcttaatctaaatgctatttgtgtgccataagttccggtaccgccttaattatatattaaaaatggagtggttttaatgaaaagacggtcttcgttccttgtttttttaggtttattattagcgtcacctttagctttggctaacgatcagcacaccgtatcgtttggttatgcacaaactcatctcagttcattgaaaaatagcgatagcaaagatctgcgaggctttaattttaaatatcgttacgagttcaatgagacctgggggatgttaggctcattcaccgcgacgcgcaatgaaatggagaactacacctggaaagaggggaaattgcataaaaatggttccgattctgtggactatggttctttgatgtttggaccaacatatcgttttaatgactatgtgagcctgtacggcaatgcgggtatagcgacgatgaaatttaataaacactcaaaagaagactcctttgcctacggcgctggcgtaatatttaatccagttaagagtatatctatcgatgcatcatgggaagccagtcgtttcttcgctgtggataccaatacatttggtgtcagcgtaggttatcgcttctgatattaaaagtataagcgttacgtttatggcaaggaattaaaaataatatggcgctgctacagaatagggatggttatgagcgctcaggtaatcttaagaggaagataaaacactcaccgtagcgttattctattgatgaaattatgataaattcactatcggaacaacttccgttaaaaacgataggtatagttttaacggatgattattatacttatttaggcatcgcttcactctttgaggatgggaagtgctttatgttcccactcaatggagaatataattcgtgtcagatatcagctagcgaagatatcataattattattgatggacgagttttgattcagggggtctggaaaggttttaaggcgctcatgcagcattatccacatgctcgtcgaatctggctcacgcgcagagatattggaaaactttatccacatggctgcgatagagatcctgatatcgatcccgatttggcaaagcctgtttttattgagcatttcattaaatacgcttgtgcaaacgatgtagcggtcggtgaaattgcgccgttgacaaaaaaggaggaggagttgttatggcactttttatataaaaagtcgatgagtcagatcgccagtagctatggcatgagtcgtaagactttgtacattcatagattgcgtatctgtcgtaaatatggcttcaaacgcttttttcatttgctatttatttaccaaagaagtcgccatatcttcgcatctaaaatttgccgtgtagacaaaaacgccgatcaggcttgaagcaaacaagatgaaaaagttaacgatgagagagtgtgaaagcatcaatcctactatgctgcttgccattaagatacttatctcggcgcttgacgaaaaaacaaaaataagactcagagagcatattgaaaaaactgaacaagaaatagcctcaagcatacatgatagcatcatgacagagacttttcttcagcaaatgaaagacattcgttacatcttaaatatagttccttgacggcgttcagaagcaagaacgcgttattatttaatgattaatagaccaggtattagtatgaaaaagatcttagtatgtttcgtcggcttggctttaaccgcatgtagcgctaattcgttgaattatggcgctgaacaggtacgggtgatgaccagcgagccaggtaaggaatgcagctacttaggggatatcacgggcagccaggggaatttctttaccggtggctggacttccaacagtaacctggaaacgggtgcccgtaacgatctgaaaaacaaagcttataaaatgggcggcaatacggtagtcctgttaacccagcgtgcaggccagacaggaagttcatggcacggttcgggctcaagcaaacaaacgaatgtcacgttaagcgggaacgtttatcgttgccctcgttaaccttattttgcaggtaatatatgcctgtttagcgcgcgcgccgcactggcgacgcgggcgctatttgggctaaccttgctttttctcactgtattcccgccaaccgccgcctaatgctttatacaggttaatgatatttaactgttgcatgagacgtgtgcgtaccaggcgctgttgtgcgccataaagcatacgatgggtatcaagcagcgtaaggtagtcatcgacgccttcctgaaaacggagtccggccagctcataggcgatttgactggcttcaaccgcgcgttgttctgattgcacctggtcattcagcgtacgctgtcccgccagaccatccgccacgtcgcgaaaggcttgctgaataacgttttcatacctggcgatttcaatctgtttttggacatgcgccctatccaggtcagcgcgtaatgcgccgccgtgaaagagaggcaaggtgatttgcggtagaaaacgccagcttcccgatcccggttcaaagagtccgctaagagacgcgctggccgttcccgccgagcctgtcaggctgatggtcgggaagaaggcggcgcgcgctgcgcctatccgggcgtttgcgccgcgcagcctgtactcggcggcgcgaatatccgggcggcgtaccagcagatctgacggtaatccgcctggcagtgtggtcgggatcgcgccttctgtaagcgtgaccgcttcgtttagtcgacgcgacagttcaggcgtgagcggctggcccaacagcaattccagcgcgttacgatcccgcgccaactgtcgcgtatacgccgcgcgattgatttcggcagaacgcagcgcgatctccgccatacgcagatcgagctgtgtggcgttacctgtccgggcaagctgggtcgtcaatgtgtatgaacttttttgcgcggccagcgtatcctcggttaagcgcagcagctcccggtcagcccgtagcgtcagccaggcgctggcgacttcggaaaccaggctcattcgcgccgcaatgtacgtctcatcaagcgccatataggcggctaatgcctggtcgctaaggcttcgcactcgcccccagagatccagttcccaggccgtcgtcgccccagccgcctcgtagcgtcggttaatctcagactcgtccatgacgctgagatcggcgggagtgcgactggcgtccatggcggtggcgatgccgagcgtcggcagcatctccgcgcgctgaatgcggtataacgcccgggcggcttcaacattgagccctgccttgcgtaaatcccgattattgcgtaacgcgatcgcaatcagttcctgtagaagcggatcgtggaagaaatcacgccagccaatgtcagcggcatccggcgcgccagaaacggttgacgttgcgtagggatagaccatcgcagtcggcgatgcggggcgttcgtgcttcggcgccatcgtacagccagcaagcgtggtgacgaaagcaagcgtcgccagcgtggcggtctgccgatagcctgtaaaagtgatcttcattatgccattcccatcattatgcttgctgatcatgcgaatcaacgcggttctcacgctttaatgccatcctgcgaaccaccacgtaaaatacaggcgtcaataacaggccgaagagcgtgacgcccaacatgccggcaaacacggcgatgcccatcgcatgtcgcatttccgcgccggcacccgtcgcgagtaccagtggtactacacctgcgataaaggcgaatgaggtcatcaggataggacgcagacgcaggcgggacgcttccagtacggcggtcagcgggtctgcgccgtcgtgttctttggcgcgggcaaactcgacaatcaaaatggcgttcttggccgccaggccgaccagcaccacgaaaccaatctgcgtaaagatattgttatctccgccagatacccacacgccgacaatggctgagagtaatgacataggcgcaataagcaggacggcgaagggcagcgaccaactgttgtactgcgccgccaggatcaggaaggccagcagcaccgccagcgcaaagatagcaagcgcagagttgccggcctgtttttcctgataaaccagatcggtccattcgaagaccatcccttccggtaacgtttcacgcacgatcttttcaatcgcgtccgtcgcctgtccggaggagaagcccggagccggtccaccgctaatatctaccgaggggaagccgttgtaatggatgattctgtccggccccgactggcgcataatcgtgacgaaagcgctaagcgggatcatctcgcccttcgcattgcggactttaagcaggccgatatcctcttgctgcatacggaatggcgcatcggcctgcgccatcacccgccaggcacggccaaatcggttgaaatcgttgacgtaaagcgagccgaggttaatttgcaacgtttcaaagatgtcggtgagcgatacccccattgatttcgcctttacccggtcgatatccacctgtaattgcggggcgtttgtctggaaactggccagcatattggccagttcgggcgtctgcatcgccttagacataatctcgctttgcacctttgtcatcgcttcaaatcccagttccgcacgatcttcaatctgcaatttaaagccgcccgtcgcgccaagccctggaaccggcggtggcgggaagatgccaataaatccgtcgggaatgtggctaaatttgtgcattagctttccggcgatagcgttagcggaaagcgaaggatcttcacgctcgtcaaagggtttcagcatggcgaacatcagcgccgaatttggcacatttaccgggccgttaaccgacagaccggggaagacgacgacgctttcaacgccgggttccgccagcgcgatagcggacatctgtttcacgaccgcctctgtgcgatccaacgatgcgccgcttgggagctgggcgatgccgacgagatagtatttatcctgcgcaggcacaaacccgttcggcacctgatggaagccaagccaggtcagccccacaaagccagcatagagcaccatcacaatgacgctgccgcgcacggcccgacggacggcgctaacatagcggttcgacgcgctgtcgaagaaacggttaaagcgatggaaaaaaccgccagtgaccgtgcccatcaaccgcgttagccagtcagccttcgcagtatcgtggtgcggtcttagcaaaatggcagccagcgcaggggagagcgtcagcgagttaatggccgaaaggatggtcgaaatagcgatggtcaacgcgaactgacgataaaactcaccctgcaggcccgccaggaatgcggaagggataaagaccgccgttagcaccgaggtaatagaaagaatgggaccagtgacttcatccatcgccttctttgccgcctctccgggacttttgccctgcgagatatgccgttccacgttttcgaccacaacgatggcgtcatcgacaacgatacctatcgacaggaccaaaccaaacagcgaaagcgtattcagcgaaaagccaaacaggtgcatcaaggcaaaggtgccgaccagcgaaacgggaaccgccaccagaggaataatggacgcccgccaggtttgcaggaacatcaccacgacaaggacgaccagcacgagggcttccagcaacgtaatcgccaccgattgtagcgatgcgcgcacgaagaccgtaggatcataggcaatccggtattcgatatcctgcgggaagttttgctgcaactcatccattttgccgcgaatcgcgttagaaacgtcaatcgcattggcgcccggactttgaataatctgtaacgctggcgccgcttcgccattcagtaaactgcgcagcgtataggcatctgcgcccagcgtgacgcgggcgacatcacgcagacgcgtcacctcgccgtcagcgccgatttttaccacaatctcgccgaactgttcttcgctggtcaggcggcccagcgtgtttaccgtcatctgaaaagcggcggaggcctccggctgttgcccgacggaaccggcggcgacctgtacgttttgttcccgcaacgccgtaacgatatcactggcggtaagaccgcggttggcgattttcgccgggtccagccagacgcgcatggcgtactcgcccgcgccccagacgagaacatcgccgacgccgggtaaacgggccagttcgtcgcgaacctgccggatggcgaagttagacaggtaaagcgagtcatagcgtttttgcggcgagacaagatgaaccaccatcaacatatcgggggacgttttctccgttacaacgccaattcgctggacttcttcgggcaggcgaggcagcgcgcgggatacccggttttgcacctgaatttgcgccatatcaggatcggttccctgttcgaaggcgatagagataaccatgcgaccatcaatggccatctgggtattcatatacaacatgccgtcaacgccgttgatcacctgttccagcggcgcggctaccgtatcggcaatcacttgcgggttagcgccggggtagctggcgctaacctgtaccgtgggcggcgtaacggccggatattcactcagcggcagttttaaaaaggcgatagcgccagccagcagcattaacagcgacaggacgatggcgaagatggggcgtgcaatgaaaaagtgggtgaatttcattggcgcaccgccttcggcgcactgtcgccgtccgctttagtcaatgtcgcggtctgtttgtcggtcacattctgccgcatcggcaccagacgtggcgcaacggtcatgccaggacgcaccagccccttgaggatgattttttctcccggcagtactccctgtgtaacgacgcggaatccatcgaccatttgtcccaactcaaccggacgatactccacctgattctccttgccgacgatcagcacatagtttttgccctgatcggcgctcaccgccagatcgtcaatcagcacggtttcccgcggctcgccgatgggcaaactgattcgggcaaacaggccgggagaaagcattccgtcggggtcaggaatcacggcgcgtgcccggatagtgccggtgctgcggttcatctgattgcccataaagtcgagtacgccctgataaggcagcccgttatcggtggttaaccccatgttgactaccggtggatttttgtcggagcgggtatgccgtaacgccttcagccaggtggcttcgtcaatatcgaaatacacatacatgggattgtgagacacgatagtcgtcagaagcgtggcgttacccgctacgccgccgctgaccagattgccccgggtcaccagtatgcggtcaacgcgtccggcaatgggcgcggtaatacgggtccaggagagttcaaggcgcgctgcggcgacggcggctttggccgattgcatctgcgcctgtcgcgcattacgcgtggcggtgacatcgtcagcgtttttacgtgatacggcgccgctggcgaccagtcgttgaatgcgatcgaaatccgcctgcgcctggcgggccagtacttcagcctgacgtaattgcgcgacggcggtgtcgagggcgacctcgaacgggcgcggatcgatctggaacagcagttgtccgcggcttaccagacgtccttccggaacgctgatggcgtcaagggttcctcccacgcgcgaacgcagctccacggtttccggcgcggccagaaaaccggtgaattccgccgtaggcgcgagtgtacggctaagggctttagcaaccggtaccgacggtggaggcggcgcgctggccggggggccgacggcgttgtctttatcccatagtgcttcgccggccatgtaaatcacgcccccgatggcggcgatgacgccggctatcaacataattttgaatgttctacgcatgtcgtttccctctttaccgcagcgtgtcggccattccgcaacgctgccgcagaatttttggcaaaggctaggcgttacaacgaaggaaaggtcaagcgttcctgacgggtttttacggggcgtgggtcggcatcgtggcgtaaatgtctcgcatcatcctcttttatgagccatctcacattctcgccgaaccgtgcagcctgaatacgcttgaccttcccacaatggcaagctttaggctttctgataccgaatagtcaggatggggaagtcgtcatgagtcagtcagaaaatcgtcacgacacgataagcttacttattgaaggtatgacctgcgcgtcgtgcgtcgctcgcgttgaaaaaggtattaaggctgtgcctggcgtaacggacgctacggtgaatctggcgacggagcgcgccaccgtccgcgggacggcgtcggcggaggcggtgatcgcggcgattgaaaaaacggggtataaggcgcgaccgatagagacggcggggcagggcgaagacgactctgaagagaaaaaagaggccgagcgcgtcaggctgaagcgcgatctgattctcgccagcgtgctggcgctccccgtttttgtgcttgaaatgggctcgcaccttattcctggtatgcacgagtgggtgataaaaacgattggcctgcaacaaagctggtactggcaatttgcactgaccctgttggtgctgacgatccccggtcgccgtttttaccttaaagggttcccggcgctggcgcgtctggcgccggacatgaactcgctggtcgccgtgggaaccgcagcggcattcggctactcgctggtggcgacctttacgcccgacctgttgcctgaagggacggtaaacgtctattacgaggccgccgcagtgattgtcgcgcttattctgctggggcgctttctggaggcaagggcgaaggggcggacttccgaagcgattaaacgtctggtggggctacaggcgcgggtcgcgcatgtgttacgcgagggccgcatcgtggatatccctgtcgacgaggttgtgctgggcgactgtgtggaggttcggccaggcgagcggatcccggttgacggcgaagtgaccgaaggccgcagcttcgttgacgagtcgatgattaccggcgaaccgataccggttgagaaatccgcaggaagcgcggtggtgggcggtaccgtaaaccaaaaaggcgcgctcacgctgcgggcgaccgccgtcggcggacagaccatgctggcgcaaatcattcgtctggtggaacaggcgcagggttcaaaactgccgattcaggccgtcgtggataaagtgacgctgtggtttgtcccgatggtgatgcttattgctgcgctgacctttgtggtatggctggcgtttgggccgtcgccagcgctgactttcgctctgatcaatggcgttgcggttctgattatcgcctgtccttgcgcgatgggcctggcgacgccgacctctattatggtgggaaccggtcgtggggcggaaatgggcgtgctgttccgtaagggggaggcgttacagctactcaaagacgctaaggtggtggccgtagacaaaaccgggacgcttaccgaaggccgcccggtactgaccgatctcgacgtggccagcggctttgaacgccgtgaggtgctggcgaaagtcgcggcggtagaatcgcgttcagagcatccgattgcccgtgcgattgtcgtgtcggcagaagaggaagggatcgcgctaccaggcatgagcggcttcgaatcggtgaccgggatgggcgtatacgctaccgttgacggtacgcgtgttgacgtgggggctgatcgctatatgcgcgaaattggcgtggatattagcggcttcgccaccaccgccgaacggttagggcaggaagggaaatcgccgctctatgcggctattgacggtcaactggcggcgattatcgccgtggccgatccgatcaaacccagtacgcccgccgcaattaacgctttacatcagctcggcattaaggtcgccatgatcactggcgataatgcccgcacggcacaggctatcgccagacagttaggaattgatgatgtggttgccgaggtattgccagaagggaaagtcgaggcgatacggcgcctgaaagcggcgtatgggcaggtggcgtttgtcggcgatggcatcaacgatgcgccagcgctggcggagtccgacgtggggctggcgattggcaccggcaccgatgtggcggtggaatccgccgacgtcgtactaatgtccggcaacctgcaaggcgtgccgaatgctatcgcgctgtctaaagcgaccatccgcaatatccaccagaatctgttctgggcctttgcttacaatacggcgctgattcctgtcgcggcaggcgcgctatttccggtctggggcatattattgtcaccggtattcgccgcaggggcgatggcgatgtcgagcgtgttcgtgctgggcaacgctttgcggctgcgccgtttccgggcgccgatggcaaccccatccgacacatccacgacatgaggaggagcgtcatgaacatcggtaaagcagctaaagcatcgaaagtctcggccaaaatgattcgctactatgaacagattggtctgattcccgcggcaagtcggacggattccggctatcgggcctatacccaggctgatgttaatcaattgcattttatacgccgcgcgcgcgacctcggtttttcagttgctgaaatcagcgacttactgaatctttggaataaccagtcgcggcaaagcgctgacgtcaaacgcctggcgcagacgcacattgatgaactggacagacgtatccagaacatgcagcacatggcgcaaaccctcaaagcgctgattcactgctgcgccggcgacgcgctgccagattgccccattctgcatacgcttggacaacctgacgatagcgagccggaggcgcgtaccggagcggtattgcgacgtcctcgtcgccacggactggcaaagcgtctgtaagtcctgagattacgcttgaccttccaacactggcaaggtccagactggcaacagttcccacacaaaaggagttcactatgcagttccatattgatgacatgacctgcggcggctgcgccagtacggtaaaaaagacgattctgactctcgatgctaatgcgacggtgagaactgacccggcgacgcgtctggttgacgttgaaacgtcgctatccgcggagcagattgccgccgccctgcaaaaggccggtttcccgccgcgcgagaggtaatcgtcaatggcgatcggtctggcgacaggccggtcgcgatacgctagccacgcttcgcttttctttgcgtgagataatccccataaaaagtgtgacaaatcatgtgtcagtaagctttgttaataatatgtaatgatttgtctatttttgctaacattttacctgctatatacaaaaagataacaaataagtagcgcaacgctaccttgttacgtcgctttgacgacgggagcgctccagcgtttcgcccgcttcaaagcttgatgttattttttgatgcaggacactacctatgtacacccccctgaactggacgacgacacaacgacatgtggcgtttgcctgctttaccagttggatgctggatgcgtttgatttctttatccttgtctttgtacttagcgatctcgccgaatggtttcacgcttccgtatcggacgtttccattgcgattatgctgaccctggcggtacgtcccattggcgcgctgctatttggccgaatggcggaaaagtacggacgtcgaccgatactgatgctcaatattctgttttttacggtgtttgaactgctttccgcctggtcgcccaccttcatggcatttctgatttttcgggtcatgtacggcgtggcgatgggcgggatatggggcgtcgcgtcatcactggcgatggaaaccattcccgatcgttcgcgtggcctgatgtcgggcatttttcaggcgggctatccctgcggctatctgttcgcctcggttatttttggcctcttctacagtatggtaggctggcgcggtatgttcctgattggcgccctgcctgttgtcttgctgccttatatctggtttaaagtgccggaatcccccgtctggctggcggccagagcgcgtaaagagaataccgcgctgcttcctgttctgcgcaaacagtggaagttgtgtctgtatctggtgctggtcatggcgttctttaactttttcagtcacggtacgcaggatctctatcctaccttcctgaagatgcagcatggttttgatccgcatctgatcagtatcattgcaattttttataacattgccgccatgctcggcggtattttctacggtacgctatcggaacgtattgggcgtaaaaaagcgatcatgatcgccgcctttcttgcgcttccggtactcccgctatgggcattttccagcggatcattcacgattggtctgggcgcgttcctgatgcagtttatggtgcagggcgcctggggtgtcgtgccgacctggctgaacgagctggttccggcgaatgcgcgcgccgtgctgccagggtttgtttaccaactcggtaatttactggcgtcggttaatgcgacgttacaggcccgcatcgcggaaacgcatggtggcaattacgggttggcaatggcgatcgtggctggcgcggtggctattttaatctgtgtatttgtggcatttggtcgcgagacccggggagtcgtcatctccggtacagatagcgacgccctcccggagtcggccatcagtcatcgcacgtaaacactacgctcctggcgcatactgtcgccgggagcacgccttcctcccgtcgttttcacgccctttcaacgaacaacaaaggttaatgatggcatctgccgttcgtgaccattacaatcatcgcttacttttttctttataagaaattgattgctgcaccttaaaattatcaacggagcgaagatatcatgttgaaagataaccaaaaacacaacgagtctgttgccccgaatagcgcctttctgtctgagttacaacgtgcattaccggaattttttaccgccgatcgctataacgagcagggcgaactgatcgcgaaaggcggatttgatctcgccagatttgagcgcgcgctgaaagcgcgtaatattgatgagctgactagcggttatcagattgattttattggcaaagattacgcaaaaaaacaggcgggtgaaaaatccgttaccgttatcgttcctgacgtggaacacaatactctggcagaaaataaaaacagccataatctttttctgaccggagataatctggatgtgttacgccatctgcaaaataattacgccgataccgtcgatatgatctatatcgatcccccttataacaccggatcggacgggtttgtctatcccgatcattttgaatatagcgatcgggcgttgcaggatatgtttggtcttaatgataccgaactggcacgtttaaaatccattcagggtaaatcgacgcactccgcgtggttatctttcatgtatccgcgtcttttcctggccaggaagctcctgaaagataccgggtttatttttatctctatcgacgataatgagtacgccaatcttaaattaatgatggatgagatttttggcgaaggcggatttgtcaccaatgtgatgtggaagcgcaaaaaagagatttctaacgactctgataacgtttccatccagggggaatacattcttgtttatgccaaaaccggtcagggcgctttacgtttagaaccgctttctaaagagtatattcagaaatcctataaagaaccgaccgaacagtttccagaagggaaatggcgaccggtgccgttaacggtgtcaaaagggctgagcggcggcggctatacctataaaattaccacgccgaacggtacggtacacgaaagactatgggcttatcctgaagccagttaccaaaaactggtggccgataatctggtctattttggcaaagataacggcggtattccccagcgagtcatgtacgcgcatcacagtaaggggcagccaacgaccaattactgggataacgtagcgtcgaataaagaggggaaaaaggagattctggatctcttcggcgacaacgtttttgatacgccgaaaccgaccgcattattgaagaaaatcatcaagctcgctatcgataaagacggcgtcgtcctggacttttttgccggttccggcactacggcccatgcggtaatggcgctgaatgaagaagatggggggcagcgcacgtttattctgtgtactatcgatcaggcattaagcaataacactatcgcgaaaaaagcaggttataacactattgatgaaatcagccgcgagcgaattacacgcgttgcggcgaagatccgcgccaacaatcccgcgaccaatagcgatctcggttttaaacattatcgttttgccactccgacacagcagacgctggacgatctggatagcttcgatattgctaccggccattttatcaataccagcggtcaactggccgctttcaccgagtcaggatttaccgacatgatcaatcctttttccgccagaggattgggcgtgccgggcggcgcaagcggcgaagagaccttattaacgacatggctggtcgccgatggttataaaatggatattgacgtacagaccgttgatttttccggctattgcgccaggtatgttgataatacgcgcctgtatctgattgatgaacgatggggaacagagcagacccgcgatcttctcaaccacattggtacgcaccagcttccggttcagaccattgtcatttacggctactctttcgaccttgaatccattcgtgaactggaaatcggcttaaaacagcttgatcaaaaagtgaacctggtgaagcgttattaagaggggatgatgatgaatattttactggaagaacttccccatcaggaacaggcgttagcggcgattctggcgagtttcaccggtatcgatcacgcgcaagccgatcataatcactatgctaatccgctgattaaggaacgttacgacgataaggccaatattgacgttaaaatggagaccgggacgggtaaaacctatgtctatacccggttgatgtatgaattgcatcagaagtatggcctcttcaaatttgtgctggtggtgccgacgccagccattaaagaaggcgcgcggaactttattaccagcgattacgccagacagcatttttcacagttctacgaaaatacgcggatggaactttgcaccatcaacgccggtgattttaaagtaaagtcggggcgtaaaaattttccggcccagctattaagttttactgatgccagccgtcgtgatagccatacgattcaggttttgctgatcaatgcgcaaatgctcaattccgccagtatgacgcgagacgattacgatcaaacgctcctgggcgggctgacgtcgcctgttaaagggctgcaaatgacgcgaccggtggtcattattgatgaaccgcatcgttttgcgcgagataacaaattttatcgagcgattcaggctattcagccgcaaatgatcgtccgctttggcgctaccttcccggatattgtcgaaggtaagggtaaaaataaatgtgtacgtaaagattactatcgccggcaaccgcagtttgatctcaacgcggtggacagttttaacgatggtttggtgaaaggtattgatatttattacccgaatctccccgaagaacaggccaacaatcgttatatcgttgacagcgtcacggcaaagaaattaatcctccgacgggggagcaaaattgccgaggttggcgtgggcgaaaatctcgccgatgtcgatgcaggatttgaaggcagtatcgaatatgccggcagtaaaatgttgtcgaacgatctggagctggaggcagggatggcgctggtgccaggaacctttggcgcgagctaccaggaactgattattcaggacgctatcgataagcattttgacactgagcaggcaaatttcttacgcagcaatgagccagaaaataatgccccgcgtattaagaccttaagccttttctttattgacagtattaaaagctatcgtgatgacgaaggctggttgaaagtcacttttgagcgtttgctgaaaaagaaactgacgcaactgattgacgattatcagcgcaagaccctgccgcgagaagtggagtatctgtcgtttctgcaggccacgctcgccagcctgcactcggataaccaaaacgtccacgctggttactttggcgaagaccgcggaagcggtgatgaggcgatccaggctgaggtagatgatattctgaaaaataaagagaagttgctcagtttttcagaccatcacggcaactgggaaacgcgccgctttctgttttcaaaatggacgcttcgcgaaggctgggataacccgaatgtttttgtcattgctaaattacgttcttccggtagcgagtcgagcaaaattcaggaagtggggcgcggcctgcggctaccggtagatgaaaatggtcatcgcgttcatcaggaagagtggccgtcccgactgtcgtttctgattggttatgatgaaaaagcgtttgccagtatgctggttgatgagattaatcgcgacagcaaagttcagcttaacgagcagaagctggatgaggcgatgatcacactcatcgtcaccgagcgacaaaaagtcgatcctgcgtttacggagcttcgtttgctggaagatctggatgataaaaaactgatcaaccggagcaatgagtttaaacccagcgtcacgcttaacggggaaaccaaaagtggttttgcgtggctactggagttctaccctgagctgacgcaggcgcgggtgcgagcggatcgcattcgtgacaataagcccgcctcccggctgcgagtcaggttacgcaaagagaattgggaacaacttagcagtatctgggagcagttttcccgccgttatatgctgcaattcgagcgtagcggcgcttctctggaacaaattgccgccgaggtgctgcgcgatccggcgctgtatattcgccagaagccaagccaggtgcaacaacggctggtatcgaatgaagataatggccgttttgaagtggcgcagcgggaaggcgaattagccgccagcgaatttatggcgggcatgaaatatggccattttcttaagcaactggcgttacgcaccagtctgccggttaacgtcctgcacccggtgttaatggcgatgctgcgtgatgttttgcacggagattcacgctatttaagcgagatctcgttggacaatatgacccgcgcattacagacgcggattaatgcgcattttgcgcagcgccacgattatctgcctctcgattttcaggcttcaacgtcggtatttgattccacggcacggcagttcagagaggagattagcgctgaaattgtggggaaaaatgtggatgagaatgcgatagacgatccccgttctctctatcaaataccgccgttgcgttatgacagcgtcgatccagaattgccgctattaaaatacgattatccgcaacaggtttctgtgtttggcaaactgcctaagcgggccattcagatccccaaatatacggggggctctactacgccggattttgtgtaccgtattgagcgtcaggacgccgacagcgtttatttactggttgaaactaaagcagaaaatatgcgcgtaggcgatcaggttattcttgatgcgcaacgtaaattcttcgatatgctgcgtcggcaaaatatcaatgtcgagtttgcggaagcgaccagcgcgccggcggtattttctacgatcaatggcttgattgaggggaaggcaaactaacgggtttgaatgaaccttaacggttatctttttgatagaccatataaaatggccgccgcgcagcgagcgttgcggtcattctccctgtgctaatcccccgtcccgtaaaccgcgttgacttgaaggttatcgttttacgtctattcttaactttcagctacgcgtattttgctgaaattgcaaatagtcttgaagacgctgtttttttgttttgccgttatttttataacggccaggtagatattgccaagtgaatgtaactaagggagacatgttatgctaaatagatactaccgtttcgctgtcgaaaaagacgacccctccgaagcgccagagtcgggcgataagcctgacagccagccgcaaaaaaaatcgtaatttatctggatattccccgacgtttatacgtttggggaaaataaccgtttcgtttcaacctggttgcgaacagtgaatattttacacgaagtgactatatataaacgggagggaacatggagtttgatgccttctttttagcgagactccagtttgcctttaccgtctcttttcatattattttccccgcgattacgattggcttagccagttacctggtggtactggaaggtttatggctaaaaacgcgtaatcctgtctggcgctcgctctatcagttctggctcaaaatttttgccgtcaacttcgggatgggcgtggtctccggtctggtcatggcttaccagttcggaacgaactggagcggtttttcccagttcgccggcagtatcaccgggcctttattaacctatgaagtgctcaccgcattcttcctggaagcgggattcttaggcgtgatgctttttggctggaacaaagtcgggccgggtctgcatttcttgtctacctgtatggtggcgttgggcacgttaatgtcgacgttctggattctggcgtctaacagctggatgcataccccgcagggatttgaaattcacaacggtcaggtagtcccggtggactggttcgcggtgattttcaacccgtcgttcccgtatcgcctgttgcatatgtccgttgcggcgtttttaagtagcgcgatgtttgtcggcgcgtccgctgcctggcatttactgaaaggtaacgatacgccggctatccgccgtatgttctcgatggcgttatggatggcggtcgtggtggcgcccgttcaggcattgattggcgatatgcatggccttaacaccctgaagcatcagccggtcaaaatcgccgcgattgaggggcactgggaaaatacgcccggcgagccaacgccgcttacgctggtaggctggccggatatggaggcggaacggacccgctatgcgcttgagatcccggcgttgggcagtctgatcctgacgcatagcctggacaaacaggtgcctgcgctaaaagattatcccaaagaggatcgccccaactctaccgtggtgttctggtctttccgtctgatggtgggcatgggcgtactgatgatcttcctggggctggccagcctgtggctacgctaccgacgccgactgtatcattcgcggccctttatgcactttgcgctgtggatggggccgtccgggcttatcgccatccttgccggatgggtgacgacggaagtaggacgccagccgtgggtggtctatggcctgctgcgaacgcgtgatgcggtttccgcgcacagtaccttgcagatgagcatcagtttgctggccttctttgtggtctattccctggtctttggggttggctatatttatatgattcgccttatccagaaagggccgcagccggcggagacaccgaccgctgaaaccgatggcagacccgcgcgtcctatctctgccgtgggagaatcgcttgagcaggagaaacgcgaatgaccatcgatcttccggttatctggtttgctattatcgtgttcgccacgctgatgtatatcgtaatggatgggttcgatctgggcgtcggtatcctgtttccgtttattcgtgataaacacgatcgcgatgttatggtgaactcagtcgcgccggtatgggacgggaacgaaacctggctggtgctgggcggggccgggctttttggcgcgttcccgttggcttatgccgtcatcaccgacgcgctgactatcccgctggtggttatgctgcttggtcttatctttcgcggcgtcgcttttgaattccgttttaaagccaccgagtcgcatcgcgcgttctgggataaatcctttatcgtcgggtcaatcctggcgacctttgcccagggggttgtggtgggcgcggtggtgagcggttttcaggtggaagggcgaacctttagcggttcgcagcttgactggctgacgccgtttaacctgttctgcggcgtcggtctggttgtcacctacgcgctgctgggcgctacctggctgattatgaaaagcgaagatccgctgcatagccggatgtgcgcgctgtcgcgcccgttgttgatcgtcttgttgttggtgatgggaggcgtcagcgtgtggacgccgctcacccacgacgacatcgccgagcgctggttcacgctgcccaatttatactacttcctgccggtgcctgtgctggtgttggcttttagcgtctggctatggcgcagcgtgaaaaaaccagaatcccatgcgcgtccatttattctcacgctagggctgatttttctggggttcagcgggttaggcatcagtatttggccgaatattattccaccggatatttcgctgtatgccgccgccgcgccgccgcaaagtcaaagctttatgctggttggggcgctgataatcatcccgattattctggcttataccttctggagctactacgtcttccgtggaaaagtgcgacatggtgagggatatcactgatggttaaagtgaaaaaatggtcgcggcgagtcgtatggatggtcgcgatatggtgcgccagcgtgcttctgctggcgggcgtcggaatgttattcagactgctcatgacctccgcaggatttcgctcctgactgatacccccggacgcgctttcgtcgctggcgaaagcgcgtttttatcgacagatcggcgtttatcgatcacctttgctcgccttatctctcccctcaatagcggttgataattattctcatctttattgtcgttcccgggccgcagtgatatggttacacagtggctaacgctctggtataacgcagataaacggtattgataatgtctccgatctcctgtcactcttccgccgccccggcgatgaaaaagatcttttccgtcagcgacttcatcgcgtttggcgagcgttatggcattgattaccgcttccctgcgttaccgcagtatacgcagagtagtcccgtacttcatggcgatatcgaagagatagcgcttcccggcgggatttgcattacacgctcggatgttcacgtgttacaaccttatgaaaccacctctcgccatagcagtccgctgtatatgctggtggtgttggaaggtaacgtcgcgctggctgtcaatgagcagacctttttgttgagcgcggggatggcgttttgctcgcaactgagtgagcagcagacgatacgcgcccatcacggcgcagacagtaaattgcgcaccttgtcgctgggaatgtacccggacggcggatggcgggagcgtttgcctgtctcgctggcagacgagtgggaaaatagcgcaacctcggcgagggtctggcaggtgccggagtttctgctttcggggctacgttatgcgcagcagcccggacctcatgcggcgtcacgccagttaatgctggaaggcatcatgctgcaattgctgggctatgcgctaaatctatgtcagccggcaacgcaaaaacgcgggcttcccgtcaccggtgaataccagcggctggagctcattcggcgtttactggagcagacgccggaaaaagcctacacgctgaacgaactggcgcgtcgggcggcaatgagtccaagtagcctgcggtgcaagtttcgccatgcctatgggtgtaccgtgtttgattatctgcgcgattgccgcctggcgcgcgcgcgtcgttatctgatggagggatacagcgtgcagcaggccgcctggatgtcaggctatcaacatgccactaactttgcgacggcattccgtcggcgttatggctgctcgcccggcgagctgcgtgacgcgtctcttacggcgtcccgccactgtgcgtaacgcgccccgccagagcggtaatatccgccgctaacccggttttctgccgctttgggtgattttttatcattgcgcataggcaatctggcgttacgcatagtggtccgtcatctctaaaaggtaataattcttatttacaataaagatgcctttggagatgttcatgtttgcgacaacgcgtatggcgctattgataggcggagctatcggcggcgcgacttttcctctttttgcccaggaaaccacaaaaaatgataccgtcattgtcacctcgcccgttcagagtggcgcgaccaagctggcgacgccagatattgaaacgccgcagtcggtatccattattacccgccagcagtttgaagagcagggcgcaaccagcgtgcgtcaggcggtcagctacaccccaggcgtatacagtaaccagataggcgcctctaaccgctttgattacatcgtattgcgtggtttttcggacggtagtctggataacgtctatctcgacgggttaaaaatgatgggcgacaccaattcgcacagttcgttggtggttgacccctggtttctggaagatatcgaggtggtacgcggcccggcgtccgttctgtatggacgttcatcgccaggcggcattgtcgcgctgacgtcgcgaaaaccggcgtttgatgccggaggagaagtgaagctgtttgccggcaataacaaccagcgcggggcggcttttgatgtgaccggcccactggatgacaatgaacgtgtggcggcgcgtcttagcggcatgacacgttacgccgattcgcagtttacccccttgaaagaggaacgttatgcgctgatgccgagcctgacctggcgaattaccgatcggacgcgtcttgatcttatggcctatccgcaccgtgatccggaaggcggtagccactccggactgccttatcaaggcacggttgtaccttataacggcggaaaaatttctaacactttctttgaaggtgaagatgactacgacaaatacgatcgccgtgaaaatatggtgggttataacattgagcatctgttcgataacggctggtcggtacggcaaaaattgcgctatttgcataccaaagtgacgttgaatcaggtctatgccgcaggttggttgaatgaaacggcgctgaatcgcggctattccggctccggggagaaaatgtcggctatcgcgctggataatcagctcgacggcagcgtggataccggggcgattaatcatcgtctgctggtggggatcgattatcaggatcgcagtaaccatactactggctattatggcgcgtttccgccgattgacgctttcaaccctgtttatggcgctcagccggattacattacgttgtatagccgtgaaaaacataagctgcggcagaccggatactatttacaggatcagatgtcatgggatcgctggcgctttacgttgggcggtcgttacgatcgggtcagcgtgtctaacatcgacaaacttcatgattcacgcagcgatctcgataaaaacaacgtcagtacccgtgctgcgttgctttatctgttcgacaatggcgtcgccccctatctcagttattctaccgcgtttacgccgaccagcttcgccgacgaaaacggcaatgtgctggaaccgatgaaaggcaagcagtgggaggcgggggtaaaatacgaaccgccgggggggaatagccagtttagcgccgccgtgtatcgtattaatcagaccaatatcgcgaccaaagaagaacctaccgatccgtaccgctcgattggtgaaattgagtctaaaggggttgaactggaggccattagccatttgtcggatagcgtccgtttgcaggcggcgtatacctatactgatatccgttataagaaaagtagcccgcaagaacagggtaagcgcgcggtttatgctccacggaaccaggccagcgcctggctaagctacgatgtgaaaagcggtctgttagaggggctgactttgggctccggcatccggtacgtcaacggcgtgaccagcgatcgcctgaatacccacacattgccgtcctatacactggtcgatatggtggtagggtatgatttatccagcattgggttaaatggcttgagcgcccagctcaacgtaaataacctgacggacaaacgctatgtcgctgcctgtaattcgctctcttattgttattttggcgccgagcgtagcattgtaggcagcgtgtcatgggcgttttgataacgcttatcgtccggtagcaaaggctaccggacaaacattagcggtgcgtcacgccttcatagagaagtctgagcgcaaacatcccgataatggcgccgataacacggctggcaatgcgctgtattcgtccataagcgcggcggactgcggggagcgaaaaggcctggctgagaaaaatacgccagataacggatgacagcacaattccggcccaggccattaaccttgcccatgtgggcgtttctgcgctaagcgttacggaaaaaatactgataaaaaacagtacggtttgcggattggataaatcggtcattaatccccggcgaaagaaaattgtccacggggcggcaatcggcgtctggagcgtgctcatttgcggcgtcgcctggtggcgaatactgttccaggcgaaccataataaataggcgccgccgacaattttgataagagaaaataccgcttcgcattgcgtaatgagcgtcgccagaccgaaaagccccagcccggaataaaaggcgtctcccgtggcgacgcccaggccggtgatgactcccgcccggcgtcctgatgcgaggctggtttgcaccaccacaaacagattcgcgccgggattaaaaaaggttaacacaaacagactgacggtaagcacaacggcatgaaacggctccatagacaactcttcccatagcctcaagaaataacgttcatcttattaatagtcaaaccagatgattgcgagtgagatcacaaagcaggggcgttttaatccgcgttgttacgccgacagagcgggggctgactggatttttccagtaatctacactacttatttaatcagtccgaacggcctttttgttctgataaagcgatgatggcgtaataataaaacgagggttttgctatgaaaactggctacaaggttatgcttggcgcattagcgtttgtcgtgacaaacgtttatgccgcagaaatcatgaaaaaaacggactttgataaagtcgcctccgaatacacgaaaattggcacgatttccaccaccggggaaatgtcgccgctggacgccagagaagatttaatcaaaaaggcggatgaaaaaggggcggatgtggtggtgctgacgtccgggcagacagaaaataaaattcatggtacggctgatatttataaaaagaaataaaagcattgcatcataaaaatacccgcctgggtttccggcgggtatatttattcctggcaaccggcatccgttttgccggatgacggcctgcagtaaacgtagcgccatcaggcattcaggacgctgtcatttgtcttaattatccgactggtctttggcaccagcttttaaacgacgccacagagtggtgcggctaatccccagataacgcgccgcggcggtcttatcgcccttaaagcgcgccagtacatcctgtaacgcgttcgcatccacggttgaaggcgtcagttctgctgtgttcaccataagctcaggtaataactgccgcataaattgcctgtccagcgttggcgcgggatcgacgcttaaaaaaagcgccaggcgctccatcatattacgcagttcgcgaatattaccgggccagcgccaggccagcaaaagcggctgacactgtgtcaatccatgacgtatcgattcggtaaacggaatttccatcgccgccagcgactgttttaaaaagctttccgccagcggcaaaatatcagcctgccgctcgcgcaaaggaggaagcgtcagacgcagaatactcaggcgataaaagagatcggggcgaaaacgtccttgcattatctcccgatccagatcgcaatgcgtagcgctgatcacccggacatccaccgggatcggctggtgtccgccgacgcgagtgacggctttttcctccagtacgcgcaaaagtcgggtttgtaacggcaagggcatttcgccgatttcatccagaaacagcgtgccgccgtgtgcgatttcaaacagccccgcccggcctcctcgtcgtgaaccggtaaacgcgccctcttcataaccaaacagttccgcttccagcaacgactcggtaatcgcgccgcaattgacggcgacaaagggaggggatggcttattctgacggtgaggctggcggtgaaagaacgtctggtgaatcgcctgcgccgccagctcttttccggtccctgtttccccctgaatcagcactgccgcacgggagcgggcatagagcgtaatcgtctggcggagctgctccatttgcggcgactggccgcgtatatcgcccagttcataccgggtttgtaatcccttgccggatgggtaatccacgcgctggcgccgtgtcagacgggtcatatccagcgcatcatgaaaagcctgacgaacggtcgccgcggaataaataaagatggcggtcattcctgcctcttccgccagatcggtaattaatcccgcgccgacgacggcctcaataccgttggccttaagttcgttaatttgcccgcgcgcgtcctcttcggtgacatagcttcgctgttcaagacggaggtgaaacgttttctgaaaggcaagtaaagccggaatggtctcctgataggtcacgataccgatagacgaggtgagctttcccgctttcgccagcgcctgtaatacatcgaatccgctgggcttgatgaggatcaccggtattgacaggcggctttttaaataggccccattcgaacccgccgcgataatcgcgtcgcagcgctcggtcgccagttttttgcgaatgtaggtcaccgccttttcaaagccgagttgaataggcgtgatggtcgccagatgatcgaattccaggctgatatcccgaaacagttcgaacagacgcgttacggagaccgtccagatcaccggtttatcgctattatcgcgcggagcgctgtgggcagtcgtcatcgcagtagattcatctttaaggggcgattttttgttttaaacgtgtttcataaatgttgcaatgaaacagggtgattcgtttcatgaaacgttagctgacacgtttttttttcccttaatcgcgcttattcataacagaaatgactgtaattacctgtttttaaatctcattgtatttaattttctcgctgcctctttgcctggcatagcctttgctttggtgaatacatcttgaataacaatttactaacatgaggacgagatatgtctttacattcgccggggcaggcatttcgcgccgcgctcgctaaagagaatccattacaaattgtcggcgctatcaatgccaaccatgctctgttggcccaacgggccgggtatcaggctatctatctttctggcggcggcgtagcggcgggctcgctcggactgccggatctggggatttctacgctggatgatgtgttaaccgatatccggcgcatcacggatgtttgcccgctgccgctgttggtggatgcggatattggctttggctcctccgcctttaatgtcgcgcggacggtaaagtccatagccaaagcgggcgccgccgcgctgcatattgaagaccaggttggcgctaagcgctgtggacaccgtccaaacaaagcgatcgtctcgaaagaggagatggtagaccgaattcgggcggcagtggatgcgcgcaccgatccgaactttgtgatcatggcgcgtaccgatgcgctggcggtggaagggctggaggcggctctcgatcgtgcgcaggcttacgtggacgcgggggctgacatgctgttcccggaggcgatcaccgaactgtcgatgtaccgccggttcgccgacgtggcgcaggtgccaatcctcgccaacatcactgagtttggcgcgacgccgctgtttacgaccgacgagttgcgcagcgcacacgtggcgatggcgctctatccgctgtcggcgtttcgcgccatgaaccgcgccgcagaaaaagtctataccgtgctgcgccaggaagggacgcaaaagaacgtgatcgacatcatgcagacccgcaacgagctgtacgaaagcatcaattactaccagttcgaagagaagctggacgcgctgtacaggaataaaaaatcgtagcctgtaggcctgataaggcgaagccgccatcaggcaatgccggatggcactacgtttaacccgcctacggtacggcctacacgcctcaataccctacacattacaataatgacgaggacaatatgacagacacgacgatcctgcaaaacaacacgcatgtcattaagcctaaaaaatcggtcgcgctttccggcgtacctgccggaaataccgctctgtgtaccgtgggaaaaagcggtaacgatctgcactatcgcggttacgacattctcgatctggcggagcactgcgaatttgaagaagtcgcgcatttactgatccacggaaaattaccgacccgcgacgagctgaacgcgtataaaagcaagttaaaagcgctgcgcggattacccgccaatgtccgtaccgttctggaagcgttaccggcggcctcgcacccgatggacgtgatgcgtaccggcgtctccgcgctgggctgcaccctgccggaaaaagagggacataccgtctccggcgcgcgcgatattgccgataagctgttggcctcgctcagctctatccttctttactggtatcactacagccacaacggcgaacgtattcagccggaaaccgacgatgattccatcggcggccatttcctgcatctgctgcacggtgaaaagccaacccaaagctgggaaaaggcgatgcatatttcgctggtgctgtatgccgagcatgagttcaacgcctcgacgtttaccagccgggtgattgccgggactggctcggatgtctactccgcgattatcggcgcgattggcgcgctgcgcggcccgaaacacggcggggcgaatgaggtgtcgctggaaattcaacagcgttatgaaacgccggacgaggcagaggcggatatccgtaaacgcgtggaaaacaaagaggtggtgattggctttggacatccggtttacaccatcgccgacccgcgccatcaggtgatcaaacgggtggcgaaacagctttcagaagaaggcggctcgctgaagatgtaccacatcgccgaccgtctggaaacggtgatgtgggagaccaaaaagatgttcccgaatctcgactggttttcggcggtctcctacaacatgatgggcgtccctaccgaaatgttcaccccgctgtttgtcatcgcccgcgttaccggctgggcggcgcacattattgaacagcgtcaggacaacaaaattattcgcccctctgccaactataccgggccggaagatcgtccgtttgtctcgatagacgatcgttgctaactcactcttattaaaaataaaacgcaggaaacgtaccctatgtctacccaagaactgaacatccgcccagactttgaccgtgaaatcgttgatatcgttgattacgttatgaattacgagatcacctcaaaggtggcgtacgacaccgcgcattattgcctgctcgacacgctcggttgtggtctggaagcgctggaatacccggcctgtaaaaaattgcttgggccaatcgtgccaggcacggtggtgcccaacggcgcacgcgtgccgggcacccagttccagctcgatccggtacaggcagcttttaacattggcgcgatgatccgctggcttgattttaacgatacctggcttgccgccgagtggggccatccttctgataacctcggcggtattctggcgacggctgactggctgtcacgcaacgccgtcgccgccggcaaagcgccgctgaccatgaaacaggtattgagcgggatgatcaaagcccatgaaattcagggctgcatcgcgctggaaaacgccttcaaccgtgtcggacttgaccatgtgttgctggtgaaagtggcctcgactgcggtggtcgctgaaatgctggggctgacgcgcgatgagatcctcaacgcggtatcgctggcgtgggtggatgggcagtcgctgcgtacctatcgtcatgcgccgaataccggtacgcgcaaatcctgggcggcgggcgatgcgacttcgcgcgcggtacgtctggcgctgatggcgaaaaccggcgagatgggctatccctcggcgctcaccgccaaaacctggggcttctacgacgtttcattcaaaggtgaaacgttccgtttccagcgtccttacggctcctacgtgatggaaaacgtgctattcaaaatttctttcccggcagaattccactcgcaaaccgccgtcgaagcggcgatgacgctgtatgagcagatgcaggccgcgggtaaaacggcagcggatatcgagaaagtgaccatccgcacccacgaagcctgtctccgcattatcgataaaaaaggcccgctcaataacccggcggaccgcgatcactgtatccagtatatggtcgccgtgccgctgctgttcggacggttaaccgcggcggattatgaagacgaggtggcgcaggacaagcgtattgacgccctgcgcgagaagatcgtgtgttatgaggacccggcttttaccgccgactatcacgacccggaaaaacgagctatcggcaatgcgatcaccgtggagtttactgatggatcacgctttggcgaggttgtcgtggagtatccgattggtcatgcgcgtcgccgcgccgacggtattccgaagcttatcgaaaaatttaaaattaacctggcgcgtcagttcccgactcgccagcagcaacgcattctggatgtctccctggacagagcccgcctggagcagatgccggttaacgaatacctcgatttatatgtcatctgagccagccagcagtaaggcgtaagttcaacaggagagcgtgatgtcttttagcgaattttatcagcgttccattaacgaaccggaggcgttctgggccgagcaggcccggcgtatcgactggcgacagccgtttacgcagacgctggatcatagccgtccaccgtttgcccgctggttttgcggcggcaccactaacttatgtcataacgccgtcgaccgctggcgggataaacagccggaggcgctggcgctgattgccgtctcatcagagaccgatgaagagcgcacatttaccttcagccagttgcatgatgaagtcaacattgtggccgccatgttgctgtcgctgggcgtgcagcgtggcgatcgcgtattggtctatatgccgatgattgccgaagcgcagataaccctgctggcctgcgcgcgcattggcgcgatccattcggtggtctttggcggttttgcctcgcacagcgtggcggcgcgcattgacgatgccagaccggcgctgattgtgtcggcggatgccggagcgcggggcggtaaaatcctgccgtataaaaagctgctcgatgacgctattgcgcaggcgcagcatcagccgaaacacgttctgctggtggacagagggctggcgaaaatggcatgggtggatgggcgcgatctggattttgccacgttgcgccagcagcatctcggcgcgagcgtgccggtggcgtggctggaatccaacgaaacctcgtgcattctttacacctccggcactaccggcaaaccgaaaggcgtccagcgcgacgtcggcggttatgcggtggcgctggcaacctcgatggacaccatttttggcggcaaggcgggcggcgtattcttttgcgcatcggatatcggctgggtcgtcggccactcctatatcgtttacgcgccgttgctggcaggcatggcgactattgtttacgaaggactgccgacgtacccggactgcggggtctggtggaaaattgtcgagaaataccaggttaaccggatgttttccgccccgaccgcgattcgcgtgctgaaaaaattcccgacggcgcaaatccgcaatcacgatctctcctcgctggaggcgctttatctggccggtgagccgctggacgagccgacggccagttgggtaacggagacgctgggcgtaccggtcatcgacaattattggcagacggagtccggctggccgatcatggcgctggcccgcgcgctggacgacaggccgtcgcgtctgggaagtcccggcgtgccgatgtacggttataacgtccagctactcaatgaagtcaccggcgaaccttgcggcataaatgaaaaggggatgctggtgatcgaagggccgctgccgccgggctgtattcagactatttggggcgacgatgcgcgttttgtgaagacttactggtcgctgtttaaccgtcaggtttatgccactttcgactggggaatccgcgacgccgaggggtattactttattctgggccgtaccgatgatgtgattaatattgcgggtcatcggctggggacgcgagaaatagaagaaagtatctccagctacccgaacgtagcggaagtggcggtagtggggataaaagacgctctgaaagggcaggtagcggtggcgtttgtcattccgaagcagagcgatacgctggcggatcgcgaggcggcgcgcgacgaggaaaacgcgattatggcgctggtggacaaccagatcggtcactttggtcgtccggcgcatgtctggtttgtttcgcagctccccaaaacgcgttccggaaagatgcttcgccgcacgatccaggcgatctgcgaaggccgcgatccgggcgatctgacaaccattgacgatcccgcgtcgttgcagcaaattcgccaggcgatcgaagaatagccgtaagccggataagccgcgttcggcaacgggttagactcagcgactgaatagtggggtgtaaagtcgggaaagggcggcagcgcgccgccctgtaacagaattaacgcagaatatttttctcagccagatccagtgcgaagtagctgaaaatcaaatcggcgccggcgcgtttaatcgagcccagactttccagcacgaccttttcttcatcgatggcgccagccatagcagcaaatttaatcatggcgtattcaccgctcacctggtaagcgccaagcggcaactctgtgcgttcgcggatttcacgcagcacgtccagatacgcgccggccggtttcaccatcaagcaatccgcgccctgggcttcgtcgagcagtgattcgcgaatcgcttcacggcggttcatcggattcatttgatacgtcttgcggtcgccttttaacgcggtacccgctgcttcacggaaagggccgtagaaagaagaggcgaacttggtggagtaggacattattgccgtatcggtaaaaccggcggcatccagcgcctggcggatagcctggacttgtccatccatggccgcggagggcgcaataaaatctgctccagccgccgccgcgataacggcctgcttgccgaggttggccagcgtcgcatcgttatccacaccgtgttcgcacaacacgccgcagtggccgtgcgaggtgtattcgcagaagcaggtgtcggacatgacgatcatctccggcacggtttgcttacagatgcgggacattcttgccaccagaccgtcttctttccaggtatcgctgccggtgtcatcagtatggtgagaaatgccgaaggtcataacggaacgaatgccagcatttgcgatacgttcaatctctcgcgccagctgcttttccgggatacgcattacgccgggcatggcatcaatagctttgtaatcgtcgagttcttcttcaacaaagatcggcaacaccaggtcgttcaggctaagtgttgtctcttcaaacatagcgcgcagcgcagcggatttgcgcaggcggcgagggcgatggataaggtctgtcatggtctgcctgatgtttgtggaatcgaaggcccagtatacctgaatctgcaggcagatgttttacgaaaacggtccttaacgtagcaggcgcagccccggcggcggcggaacatggcgcttcttttatataccgaagattaatacctcaggcactatatcattttaaataagaattagttttacgttgtttttagttttatttcatcgtcatttaagtaaatgtgggttttaacattattcatgtttattttgtttttctttaatctatatttatcttatatgtattttgtttttttattttcttgtaaggtcatgaaaaagaatgcttttcaattataaaacttccttttattacgtctttttaattcatgtccgaatccggactgaggataaagaataattgaaccttttagcaatgacgccgcataatccttcttgctaaacatctgtatgtttttatgcattgataattgatggatcaactatattacgtccctgaggagggatgacaaatgcactcctggaaaaagaaacttgtagtctcacaattagcattggcttgcactctggcaatcacttctcaggcgaatgctactacttacgatacctggacttattacgacaatcctaccaccgcgcttgattggaataatatggatgccgcaggcactgttgatggtaactatgtaaactatagcggtttcgtttactacaacaatgccaatggtgatttcgatcagacgttcaacggtgacactgttaacggtacgatttctacctattatctgaaccatgattataatgacgcaaccagtaatgagctgaatattagtaattcagttattcatggctcgattacttccatgctgccgattggttattacgatcgttttgatacgttggatcacgatgggtattctgaatattatcggttcaacaacggtactgatactgttgacggaaactggtatgacggtgatgtgttcacgctgaacatcgctaattccaccattgatgatgattatgaagcgttttacttcactgattcctataaggatggtgatgtaactaagtacacaaatgaaacattcgatgtcagcgaaggcgtggcggtgaatcttgatgtagaaagcaacatcaatatttccaacaattcccgtgttgcaggtattgccttgtctcagggaaatacttacaacaacacttacacgacggaatcccataactgggataacaatattaatgtatttgactctactgtaacttccggttcagattatatcctggatagtgcttatactactgacactggtacttttggcacaggtcactttggcaattccgatgagccgagcgattatactggtgctggcgacgttgcattatctttcactgatgacaatggtgcttcagactatgcaatgaagaacaatgtgtacttcagtaattctacgctgatgggtgatgtcaaatttaccagtaactggaacgccaatttcgatgctgatggtgatgatactaacggtgatggtgttcctgataccaaccatggctgggctgatgacggcctcaacgtcgacgaactgaaccttacacttgataatggcagtaagtgggttggtcaggcgacttatactgttgatacaacgtcccgtatgtatgatgttgaaacgaacagccttactccaggcgcaacattggaagataatgcctggaatcgtatcgttggtaatgaagttttccagagcggcgtgtttaacgtgacgctgaacaatggttctgaatgggacaccgttggggactcgactgttgatacgctggctgtaaacaatggttctcaggttaatgtttctaattctgatttaacatcagacaccattgatttgactaatggttcttcactgaacattggtgaaggtggttatgttgacaccgatcacctgacaattgactcctatagtactgttggtttgaccgaatctactggctggagtacttactcaaacctgtatgctaataccatcaccgtaactaacggtggtgtgttggatgtgaatgttggtcagtttgataccgaagtattcagcactgataaactggaactgaccagcggcaatactgctgatcacaacggtaatgttgtttctggtgtgttcaatatccatagcagcgattatgttctgaacgctgacctggtgaacgaccgtacctgggataccactcaggctaactatggttacggtactatcgcaatgaactctgacggtcacctgaccatcaacggtaatggcgatatcaacaacggcgacgaactggataacagctctgttgacaacgttgtagcggctaccggtaactataaagttcgcatcgacaacgctactggtgccggttctgttgcggattacaaaggcaacgagctgatttatgtcaatgacgtaaacaccgacgcaaccttctctgcagcaaacaaagctgacctgggtgcttacacctatcaggctaagcaggaaggcaacactgtcgtgctggaacagatggaactgaccgactacgctaacatggcgctgagcattccttctgcgaacaccaatatctggaacctggaacaagacaccgttggtactcgtctgaccaacgctcgtcatggcctggcggataacggcggcgcatgggtaagctacttcggcggtaacttcaacggcgacaacggcaccattaactacgatcaggatgttaatggcatcatggtcggtgttgataccaaagttgacggtaacaacgctaagtggatcgttggtgcggcagcaggtttcgcgaaaggcgatctgagcgatcgtaccggtcaggtggatcaggacagccagtctgcctacatctactcttccgctcgtttcgcaaacaacatctttgttgacggtaacttgagctactctcacttcaacaacgatttgtctgctaacatgagcgacggtacttacgttgacggcaacacatcttctgacgcctggggcttcggcttgaaactgggttatgatctgaagctgggtgatgcaggctacgtaacgccttacggcagcgtatccggtctgttccagtctggcgacgactaccagctgagcaatgacatgaaagttgacggtcagtcttacgacagcatgcgttatgaactcggtgtagatgcaggttataccttcacttacagcgaagatcaggcgctgaccccgtacttcaaactggcttacgtttacgacgactccaacaacgatgctgacgtaaacggcgactctatcgacaacggcgtagaaggttctgcggtacgtgttggtctgggtactcagttcagcttcacgaagaacttcagcgcctacaccgatgctaactacctcggcggcggtgatgttgatcaagactggtctgcaaacgttggtgttaaatatacctggtaatcattttctctcaggagaaataaaggtaatttaaactgaaaaatgcccgtcaaggacttgacgggcattattgcaaggaatgcatatgttatctttaagcaagccactacaggaattctacagactcgataaatgcctttctaagcatggtacgcgtttcgagtttgttaacgataaagagattatctgttcacctgatgaaagtaatacccatacctttgttattttagagggggttgtttcgttagttcggggtgataaagttcttattggtattgtgcaggccccttttatttttggcttagccgatggcgtggcgaaaaaagaggcacaatataaattaattgcggagagcggttgcatcggttatcgcctctcatcatcacaaactctcgccatcattgagcagaaccaactgtggcgtgaagccttctgttggatagtatggaaaagtcaggtactggaacttcgtgacaagcagctcattggtaataattcttacgaccaaattcgtgcgacgttaatgacaatgattgagtgggatgaagaacttcgctcacgtattggtgttatgaattatattcatcaacgaacgcgcgtatcgcgatcggtggtggcggaagttctcgcggccctgcgtaagggtaattacattgaaatgaataaaggcaaactgatcagtattaaccgtttgccctccgaatattaacaaaaatgttgcgcctcgtctgatatagcgcgaggcgcgacgactcaggatgcaggaatagcaatcggtttattgccgcttagctcagtaaccaaatcgttaatcccgtcgctcatattggtaaaacgagtgaggggggaacgggttaccaccacaaaagcgccaatattatattgcgggatcatcgccatataggtaataaaaccgccgccgcctcctgttttctggataatgccaggacgtccgtcttttggcgccatatagacccaacccagaccgagcgcgtcggctttacccggtacgtccatcccgatgattttctttaactgtatgcgctgataaatcaacgtttgcatacgatcggcctgttggctacggtgatagaaatctgacgacagatactgttgcatccagcgcatcatatctcctggcgtagaatagaccccaccgctgccaatggctgccagcgtattattacaggggcttgcgcctttttctgccaccatcagacgcttacactgatcgggagaaggggtaaacgtggtgtctttcattcccagcgggcgggtaatcttttcttcaaacagttgcgtataaggtttgccggaggcggtcgccagcgcgtcggctaacaggtcgaacgccagattggaataggccgcctgtgaaccgggcgcgacttttaacgttgctgtggagagccagttccagcgttgttcgcgggttggccagacaaataccggacgatgcgccgcgccgccgggctgttctcgcggaagcgcgctggtgtgggtcgctaagttgaccaacgtaatcggcgtgccttgatacgtcgggacacgcgcgccgggaggcgcatatttgctgagaggatcgtttaattttaccgttccctgatcgagcaattttaccaacatttcactggtcatgagcttggtgagagaagcgatacgaatgaccgaatcaagctgtggacgaacattattgcccggtctggtgtcaccgaaactacgaaacacgcgttgattgccgtcgatcaccaccagcgccatgcccgtggcgccgctaccataaaagatatgctcggcataacgatcaacgatatcagaggcaaaaaccggatcggcaatcggctgagccgcctggacagaagtaagtgatgccgcaaacagcatggcagtaaaaagcagactacgtttcaacggtgatgtccataagtgaaataacggtggttatgcgtatttatactacccggcggcacattgcaaaacgttaaagagaaaaaagtgggtgaaaaaacgtaacggcgggttttcgtgatggagaatgtttacttttgtgatagagcgcttgtgataacctgatagcgtcagcgtgcctgctgtgtatgaaactcgtcgaaacaattctgttgagcagaaatgcgaactaagcgtcacaacgtaggtcacaatgcctggtttagccctttcatttgcgtgggcatggcgtgctattgccgccgtcacagcagccgtaataaagataagaagttagcaggagagcatgatgtttaaatcttttttcccaaagccagggccgtttttcatgtcggcgtttgtttgggcgctgatcgccgtcattttctggcaggcgggaggaggagattgggtggcgcgacttgtaggggcatccgatgaagtgcctatcagcgcagcgcgcttctggtcgctggactatctgattttttatgcttattacctgatttgcgtgggattatttgcaacgttctggttcatctatagcccgcaccgctggcagtactggtcgatacttggcacctcgctcattatttttgtcacctggtttttggtggaggttggcgtcgcggttaacgcctggtacgcgccgttctatgatttgattcaaacggcgctcagctcgccgcacaaggtcactcttggtcaattttatcatgaagtgggggtgtttctcggtattgcgcttatcgccgtggtgatcggtgtgctgaacaacttctttgtcagccactatgtatttcgctggcgtaccgcaatgaatgagcactatatggcgcactggcagtacctacgccatatcgaaggggccgcccagcgtgtgcaggaagataccatgcgttttgcctctacactggagaatatgggcgtgagttttatcaatgccatcatgacgctcatcgcctttctgccggtgttagtcaccctgtcagcgcatgtgccgaatttacccatcgtagggcatatcccttacggcctggtcattgccgccatagtctggtcattaatggggacgggcctgctggcggtcgtcgggatcaaattgccagggctggaatttaaaaatcagcgagtggaagccgcttatcgtaaggagctggtctacggtgaagatgacgccagccgcgccacgccgcccaccgtccgtgaactgtttagcgcggtgcgccataactactttcgtctctactttcactatatgtatttcaacatcgcgcgcattctctatttgcaggtcgataacgttttcggtttgttcctgctgtttccttccattgttgccggtacgattacgctggggctgatgacgcaaatcaccaacgtgtttggccaggtgcgcggttcgttccagtatttgattaactcctggacgacgctggtggagctgatgtctatttataaacgtttacgtagctttgaacgccagttggatggtcagccagttcaggaagtgacccactcttttagctaacagaaggaaacgttatgtcggcggcgtcccgtctttatcctctgccttttctggcggttgccatattggctggctgtagtagtcaatccgggcagccggtgagcaagggcgagaagcctgtcgacgtggcaagcgtagtacgtcagaaaatgccagccagtgtcaaagacagagaggcctgggcgaaagatatcgcgacaacgtttaagagccaggggctggcgccgacggtagaaaatatctgttcggtgctggctgtcgcccagcaggagtccggttatcaggcggatcctgtcgtgccggggctaagtaaaatcgcctggcaggagattgatcgccgcgctgaacgactacacatcccgctgtttctggtgcacaccgcgctgaaaattaactcccccaacggcaagagctatagcgaacgcctggacacggtaaaaaccgaaaaacagcttagcgctatttttgacgattttatcaatatggtccctatggggcagacgctatttggctcatataacccggtgcatacgggcggcccgatgcaggtcagcattgcctttgccgaacagcacgcgaaaggctatccgtggaagatgacgggtacggtacgtcaggaggtctttacgcgccgtggcgggttgtggtttggaacctaccatttgctgaattacccggcgaactacagcgcgcctgttttccgcttcgccgacttcaacgcgggatggtacgccagccgtaacgctgcgttccagaatgccgtcagtaaagccagtggggtaaaactggcgctggatggcgatctgattcgttataacagcaaggaaccgggcaaaacagagttagcggtacgcaaactggcagggcagttgggaatgagtgagcgtgaaattcgcagccaactggagaaaggcgatagcctggcgtttgaaaaaacggcgctctacaagaaagtctataaactggccgaggccaaaacgggcaagacgcttgcgcgggaaatgttgcccggtattcaactggaaagtccgaagatcacacgcaagctgacgaccgcctggtttgctaaacgagttgatgagcggcgggcgcggtgtatggggcgataaatttcgcgctgggatactttctccagcgcgctaaggtttattggtgacggtgacgccagcgtaaaaacgcggcgataacggcgaaaatgaggcagcccgtgaggaagggcaccaggccaaaaatcgtcccgacgcccagcccaatctctacccgcggtcgacctgtatcctgtacctgcatcagatgctcatagatgcccggcgcatgaaccagcaggtttaagagttgcgctccggcccagaagcaaaacagtacaaatatggcgtaagcaatatttccgggcgtagaggaggtttctcgatgcttcccgctgaacagcgattttgagagagtgaaatcagccataaagacctccaggatgatcggctacgatctggcgttatgccatcggcttactgtgaagtctgacaggtcattgtgtttgtcaatatcagaatcatggtaatttcacatacggaatgtatccatcgcgtaaatttttgttagttgtcacaaaacgatcacttttatcaaaatcaattaacatttaagaaattccgtatcccccacagactcgctcgccagaagtatgcaaaaatacgtttttgttactgttaatacgtcggagtcgttatgcgtttgcctgtaaaaattcgtcgtgactggcactactatgccttctctattggccttatctttattttgaatggcgtcgtaggattgctgggttttgaggctaaaggatggcaaacctatggcgttgggctggtaacatggattattagcttctggctggcggggttcattattcgccggcgcgaagaggatgaggtaaaagacgcccgataaacgttgcgctatcgggcgtgcgctattacatcgtggtttttaaggcgttattcgccgtatggcgttccagcgccagctcaatcagacggctgatcaaatcggtatagcccagtccgctcgcctgccagagttttggatacatactgatattggtaaaacctggcagcgtattgatctcgttaatcacgacctcattgtctgccgttaagaagacatcgacacgcgccatacccgcgcatcccagcgtctgataagcctggatcgcgatcgcgcggatcttgtcattcacctcggaagggatctgcgcaggcacgacaacttgtgcgccattatcatcaatatacttagtatcgtaggcgtaaaattcgctgttcagtacgatttcgccgcaggtactggcctgtgggttatcgttacctaatacggcgcattcgatctcgcgccctttgatcccttgctccaccaccactttatgatcgaattcgaaagccagcgcgaccgcctgctgatattgcgcttcgttagcgactttactgacgccgaccgaagagccctgattggcgggcttaacgaacagcggcagtcccagacgggattcaacctcggcaaaactaaacgcgtgacgattcgttcgggtgagtgtaataaacggggcgatattcagtccggcatcgcgtagcagtcgtttggcgacgtctttatccatgcaggctgcggagctcagcacgtctgaaccgacaaacggtaagtttgcgacgcgcagcatcccctgcaatgagccgtcttcgcccagcgtaccgtggacgataggaaaaataacatctaccgtcggtagcggctgcccgttctgagcgttaatcaattggtgttggtgtttgccaggcacctgggccagactgattgccgaaggacgtagcgcgatatgtgccggatcgtctgcattctgcaaataattttccgcatcgttaacatgccattgtcccgccttatctatccctaacagcaccacgtcgaagcgggttttatcgatcgcatcaacgatatttttcgctgattgcaaagacacttcatgttccgccgacttaccgccaaatactattcctacccgcaatttcgccatcttaaaaacccattccatcgaatgcaaagcgtatacattaccacgacaaaacgcgggtttcgcgggcttctgccataatgtttatgggatgtgagaacggaggccgcgtgagaggtaagggttttctgattattgtgctgttgggcggcattggcgggctgggatatcgttatcttccctcttattataatccttttgctccgctacaacttgccgatccgccaggctggatcactaccttcaaactacagcgcctgacgccgtcgcagtgccgggagcttttgacggcggccaatcaacagggattaatttcatcacaacctgttgcggatagcgctggtgaatgtcccttatcccatgttgtgcgcgtcagagattttggccaggtaaaactgagcagcagttttttagcctcctgcccgttggcgctgcgctccgcgctgtttgtcgaacagcaggcaaaacctttaacagaaacgtggatgaagcgccgcctgacccgtatcgaacatctgggcagctatgcctgccgtaatatttatcaccgcccggatgcgcgtcgcagtgaacatgccagcgcagaagcgctggatgtcagcgggtttcagctatcggatggccgaaaaatcactgtcctgcgcggctgggggcgtcaggagacggggccctggttacgcgctatgttaaacgccagttgccattattatggcaatgggctcgggcctgactataacgctgcgcatgctaaccattttcatcttggaatgcggggctacggcgtgtgtcgttaaagcataaacgtctgccttgcgcggctatataatgtgacatgtttcacaaaaatgatgaacggggagacaaaatagcaaagtgtgacgtatcgcacctctggaaccaccaggaaaaagagaacttgctaagctaacgcgtattttcagctacttaccgttacgagtcttatggaatcctggaaagttaatctaatttccgtttggtttggatgtttttttaccgggctggcaatcagccaaatcctgccattcttacccctttatatttcccagcttggcgtctcttcccatgaagcgttatcaatgtggtccgggttaacgtttagcatcacgtttcttatttccgccattgtgtcgccgatgtggggcagtctcgccgatcgtaaagggcgtaaactgatgctattgcgcgcgtcgctcgggatggcgatagctattctactgcaggcatttgcgacccatgtctggcaacttttcctgctgcgcggaatcatggggttaacgtcaggctatatccccaatgccatggcgctggtagcctctcaggtaccacgcgaacgtagcggctgggcgctcagtacgctttctaccgcgcagatcagcggcgttatcggcgggccgttaatgggcggctttgtcgcggatcatatcgggctgcgggcggtatttctgattaccgccatgctgttggtggtgagctttctggtcacgctatttttaattaaagaaggcgtgcgtccggtcatcaagaaaagcgaacgcctgagcggtaaagccgtttttgcgtcgttaccttatcctgcgctggtgatcagtttgttttttaccacgatggtcattcaactctgtaatggttccatcagtccaatcctggcgctgtttatcaaatcaatgatgccggacagtaataacatcgcctttcttagcgggttaattgcctcggtgcccggtatctctgcgcttatctccgcgcctcgcctgggaaaacttggcgacagaatcggcacggaaagaattctgatggccacgcttatctgcgcagtgctgcttttcttcgcgatgtcctgggtcaccacgccgttccagctggggctgttacgtttcttgttaggctttgccgatggcgcgatgttacccgccgtacaaacgttattggtgaaatactccagcgatcaaattaccggacgtatttttggctacaaccagtcatttatgtacctgggcaacgtggttgggccgttgatgggcgcgacggtatcggcgatggccggtttccgctgggtttttatcgctacggcggcgatcgtgttgatcaatatcgggcaactgaccctggcgttacgtcgtcggcgtaacgcgcaaaaagcgaaaggccaatagcggtgcatcgtaacggcgcttctgccgttacgatatggtttaaattaaaagatatattctttatccgtgaagtttttctatagatggcataaccttaaattatgatatagcgtgattattgttttttgatggtttattatcgtctcgttttcggtctgagaaacgtttcgctgcggcgacagtgataattatttgtgtaaagttcttcctgtatcataaaaatagtactttcagcctctaggcagtggttcttcatagtgataacgtcaccctggaactaataaggaaatatggtcatgaaaaatctcatagcagagttgttgcttaagctagcccaaaaagaagaagagtcgaaagaactggttgctcaggtagaagcgttagagattatcgtcacagcaatgttacgtaacatggcgcaaaacgagcaggagatgttgatacgtcaggtagagggggcacttgaaggcgtaaagccggatgccagcgttcctgatcacgatacggaattgctgcgccaatatgtaaaaaagttgctgagacacccccggcactaatcgtatttaaaacaacacagttgttataacgttacttttatgaaataacatagccgcttcgtttttattttcttctgggtaatacagagcaaaataaaaacgaagcggctatggtaataacagtgtaacgttatgcgctgttcttctgcatcctgccagtgtaactgtggataatcgaattgcacattagcctacggtttgtcaatcaataaaacatctattgctaacggtaagtaatacttttacagccgggtggtatttttgccagtaacagccagacttatataaagtccctgggatatttcccaaagggacaacgtgtaatgtgtacactgacaaaaggatggtgctatgaaaataacattactggtgactttactttttggcctagtctttttaaccgccgtcggcgcaaccgagaaaccgttaacgccgcaacagcagcgcatgacgacctgtaatcagcaggcgacagcgcaagcgttgaaaggcgatgcgcgtaaaacctaccttagcgactgcctgaaaaacagtcagtcagcccctggcgagaaaagcctgacgccgcaacagcagaaaatgcgtgaatgcaatgttcaggcgacggaacaatcactgaaaggcgatgaccgtagcaagtttatgagcgcctgcctgaaaaaagcggcgtagtgctatcgggtgagtcctgaaaaacactcacccgaaatttcatacttcctccatgcgctctgtttctataatttgggaaaattgtttctaaatgttcccaaaaataatgaatgatgaaaatttttaccgaaaagcggttgaacaggcggtagcgccgcctgaccctcctgatgatcgtcagcgctccgggttgcgcttcgcccggcgcatcaggctaccgcgtgcggtggggttaggggggatgtttttaccggtggccgccgtgttagtgacgcaacctgtctttggcggctggtggctattgctggtcggctggtcttttgtctggccgcatctggcatggcagtgggcggcgaaagcccttgatccgctacgccaggaaatttacaacctgaaagtggatgcgatcctctccggcatgtggatcgcgctgatgggcgtcaatatgttgcctgccgccgcgctgtttatgatgatgagcatgaatctgatgggcgctggcgggcggcggctattcactgtcggaatgggccttttgctggcgtcatgtctggtgacgttgcagcttgccgggctacccgtcgcgatgcgaagctcgtcgctggaagtcacgctctctttgcccgtcattatgttgtatccgcttctgttcgcctgggtaagttaccaaacggccattaaattagcggaacataagcgacgcttgcaggcgatgagctcgcgggatggcatgaccggcgtctataaccgacgccactgggaaattttattacgtaatgaattcgatcacagccgacgccaccatcgggaggcgacattgttgattatcgatatcgatcattttaagagcattaacgacacctggggacatgatgttggggatgaggctattatcgccctgacgcgtcaattacagataacgctacgcgggagtgatattatcgggcgctttggcggcgacgaatttgcggtgattatgtgcggaacgccggcagacagcgcgattaccgccatgtcgcgagtgcatgaacggctaaataccttacgcttgccgggcgcgccgcaggtcatgttacgtatcagcgtgggcgtggcgccgttaacgccacaaatcggtcattatcgggaatggctaaagtctgcggatatggcgctttacaaagcaaagaatgccggacgtaaccgcaccgaagtggcggcatgacgtccagccgggcttcaggatttactgagcgcctctgatttttccatacacttcgtcatcgcttctattaccgcagcgcggaagccacgttcttccagaacgcgtacggcttcaatcgtcgttccgccaggcgagcacaccatatctttcagttcgccgggatgctttccggtttcgagtaccattttcgccgaccccatgacggcctgcgcggcgaatttataagcctgagcgcgaggcataccgcccagaacggcagcgtccgccatcgcctcgataaacataaagacataggccggcgaagatccgctcacgccaaccaccggatggatcatcggctcagcaatcacttccgccccgccaaagcagcggaaaatattcagcacatcagccgtatcttccggtgtgaccagcgcgttgggcgtgacggaggtcattcctgcgttgaccagcgacggcgtattcggcatagcgcgaatgattttacggtcgtgtcccagcgcgcgcgcaagctgatcaagcgttacgcctgcggcgatagagaccaccagcgagtctttgttcaggctggaggagatttcactgagcactttcaccataatgcccggttttaccgcgccgaaaacgatatccgcgacctgagcgacctcctgcgcgctttgcgccgcattaatgccgtactgatcatgcagggcggcgactttatcgggggagggggtatagacccagatctggccgggaagtacctgaccgctggcaatcagtccgccaagaatagccttgcccatattaccgcagccaataaaaccgattttcttctccatctcgtcactccctatgtttgtgtgttatggggaatggttagcttaacgcggattgaaaacgggcagaaggagaaacagcactttgatgaaagacaaaagcgcgagacaataaaagattgtataccgtacgggagacattatgaccatctgggtggatgcggatgcgtgtccgaatgtcattaaagaaattttgtaccgcgccgccgagcggatgcagttgccgcttattctggttgccaatcaggccttgcgcgtgccgccttcgcgttttatccgcacgcttcgcgtggccgccgggtttgacgtggcggataacgaaatcgtgcgtcaatgcgaagcgggcgatctggtgattaccgcggatattccgctggcggctgaagtgctggaaaaaggcgctgcggctcttaatccccggggagaacgctatagcgacgccacgattcgcgaacgtctgacgatgcgtgactttatggacacgctacgcgccagcggcgtacaaacgggggggccaaacactctctcgccgcgcgatcgtcagcattttgccgccgagctggataagtggtggctggaaagccagcgtaaaaaataaatcatgtaatgaaaaatttacagtttattcatttctgattcttgctatagtactaatattgtgactttagtacctttgtgtaaattattatttacatttatgcgttgtactagttagatgatatgattataacattgctgatatcaaatcctgcgtatgcgcagttcctgggggaacgcctgctatgatgcaacctctttatcttgttggcccgcggggctgtgggaaaaccaccatcggtatggcgctggcgcaggcaaccggttttcggtttgcagataccgaccgctggctgcaatcgcacgtgcagatgagcgtcgctgatatcgttgaaaaagaaggctggggagggttccgcgcccgggaaaccgcggccctggaggcggtaagcgcgccttcgactgtcgtggcgacgggaggcggtattattctcacggagtataaccgacgttatatgcaccgtgttggcgtagtgatttatctgtgcgcgccggtatccacgctggttaaccggcttgaggctgaacctgaagcggatctgcgcccgaccctcaccggcaagccgttgagcgaagaggttcgggaagtgcttgagcagcgtgacgcgttgtatcgcgaaacggcgcattacattattgacgcgacgaaagcgccggcccaggtcgtttctgaaattattgcggcgctgccgccgtcgacgcaacggttacagggagatgtctatacttaacgctcacccagaataaaggaaacgctatgccaaccagaccaccttatccgcgggaagcttatatcgtcaccattgaaaaaggcacgccgggccagacggtgacgtggtatcagctacgggctgaccatccgaaacctgattcgctcatcagcgagcatccgaccgcagaagaagcgatggatgcgaaaaatcgttacgaagatccggataaatcatagacgcatgaaccactcggaagggattctgagtacccctaaattgtatctccatcacattcttgaaacatttatactggcaactaaaaccgtaaattaagcgataacaatacaatattggagttatttggaatctttacacaatacgttgctcatctgctgctacgctttctgagatttgtagggcaggtagcgcggtgagcgtgtgaatatttgcccgggaattacgacgaagtaataaggtggaataaaaatgagtgcgtcgttggcaatcctcacaatcggcgttgtgccaatgagcgaagtgttaccgcttctgacggaatacatcgacgaacaacacatcacccatcatagcctgctgggaaaaatgagccgggaagacgttatggcggattacgctgtagagcctggcgacgatccgcttttgacgttgctgaatgataaccagatagcccatgtttcccgccagaaagtggagcgagatttacagagcgttgtcgaggtgctggataatcagggttacgatgtcattatactgatgagcaccgcggcgattaaaagtatggcagcccgtaattctattttgcttgaaccgctgcgtattattccaccgcttgtcgcctctattgtggatggacatcaggtgggcgtgattgtgcctgttgcagaacttctggcggcccaggagaaaaaatggcaggtattgcaaatgccgccggtgtattcgctggcgaatccggttcacggttctgagcaacagttaattgatgccggacaggcgctactggatcaaggcgcggacgtcattatgctggattgtctgggttttcatcagcgtcatcgggatattttacagcaggcgctggatgtgccggttttactctctaacgttttgattgcgcggttagcttcagaactgcttgtctaattttacgtgacaggccgaacgtcaggactctatattgggtgttaatttaataatgagacggggcctgattatgctacaaagcaatgaatacttttccgggaaagttaagtctattggatttaccagcagtagcaccggccgggccagcgttggtgtgatggcggaaggggagtatacatttggcaccgccgaacccgaagagatgacggttgtgagcggcgcgttgaaggtactgttgccgggaactgtcgaatggaaagtgtatacagccggtgaggtgtttaacgtgcctggccacagcgagtttcatctccaggttgctgagcccgcctcgtatctgtgccgctatttgtaacggtgagtcccctctccggcggagaggggccctctggttagcgctgcgcttcgccgcctaatccttccaccaggctttgaatcagcgccgccagctcgccggtcatcaggataaagtccgcgtcaaaacgttgggcaaaatcttcccggtcgatatcttcgttctggtcgcgcagctcatcgcagaatttcagacgcttaatggagccgtcatcgcacatgacgaattgaatgcgctgctgccagtcgagcgccagcttcgtgaccactttacccgcttcaatatgaacggcgatctcgtcgctgaccagatcctgctttttcgcgcggatcacgccgccatcttccagcatcgctttcaattcggcttcgtccagcaactggaaaccctgagcgaccgtaccggagcgcacccactcggtgagcgtcagctcaatcggattttccagcgccagcgggacgaccggcagcgagccaagacttttacgcagtagcgccaaagtatcttccgcttttttcgcgctggcgcagtcaaccataatcaggccgttaacggtatcaatccacatcattgtctgactgaagcggctaaacgcgcgcggcagcaacgaatgcaacacttcatccttcagggaatctttttccgtcttcttcagcttgcgtccctgatcggcttccagtttctggattttcgcctccagtgcctgtttgatcactggcgatggcaggattttctcttctttgcgcgcgcaaataataatttggccattggcggtgtgcgttaacgcatcgctgtgagagcccatcggcggaacccagcccattttggccatatcctggctaccgcatggggtaaacgtcattgaggcgagctgtttctccatctcttcggcgcgtaatgtaatatcgcggctaagacggtaaaccattaaatttttgaaccacagcatgataatttccacggccttgtcgttaaatccaggcggtatagtaacgaattgtcggcaggcttgcattgccaatcagaacggtgaattctaccctgttgatattcccaaaaaatgaggagcggtatgtgcgtattggtatcgatttaggcggcacaaaaacggaagtcattgcgcttgatgatgcaggagagcagcggtttcgccatcgtctgcctacgccgcgggaggattatcagcaaacgatagaaaccatcgctacgctggtcgacatggcggaacaggcgaccggccagaccggtagcgtcggcattggcattcccggttctctctcgccttacaccggcgtggtgaaaaacgctaactctacgtggcttaacggccagccgttcgatagcgatgtgagccgtcgtctgaagcgtgaagtgcggttagccaacgatgccaattgcctggcggtatcagaggcggtggatggcgcggcggcgggggcgcaaacggtatttgcggtgattatcggtaccgggtgtggcgcgggcgtagcgctaaatggccgggcgcacatcggcggcaacggtacggcaggtgaatggggccacaatccgttgccgtggatggatgacgatgagttgcgttaccgcgaagaaattccctgttattgcggtaaacaaggctgtatcgaaacctttatttccggtacgggatttgccacggattaccagcgtttgagcggtaacgcgctaaaaggcgatgagattattcgtctggtcgacgcgcaggacgccgtggcggaactggcgttaagccgttatgagctgcggctggcgaaagcattatctcatgtcgtgaatattctggatccggatgtcattgtgctgggcggcggtatgagcaatgttgagcgcctgtacaagacggttccgtcgctgatgaaatcgtttgtttttggcggcgagtgcgagacgccggtacgtaaggcgcggcatggcgattcgagcggcgtgcgcggcgcggcctggctgtggccgctggcgtaacgttgttagccggatggcgcgtcatccggcaaccggcgtgaccgatggctgcttgtgttttagacgtccgtataccagcaacgacgacatggcggaaaacgagagcagggcggcgggaagcgccacatagtggtacgcaaaacctagtgtcagcatcagcccgccgcaccaggcgccaatcgcgctaccgagattaaacgcgatttgccctcccgccgcgcccagcagttcgccgcctttggcgttttgcagtagcaggatttgcagcggcgcagagagcgcaaacagaccagcgcagcagataaacgcgaaagtcagcgatgtcgttttgtatccgctgaagaaaaagagcgccatgagagaaagcacgataacgaggtcagtcactaccgcgatgcgcagcggagtatatctgccggagagtttgccgcttaacagattgcctaacaccatccccagcccgaccagcatcataataaacgtcatgctcgtctccgaaaaaccggagatgtacatcataaatggcttgatatagctgaaccaggcaaaaacgcccgcattgccgaacatcgtggcggcgaaaatgagccacggcgaggggctacgcaagaagtgaaactgctcgcgcaggctgccttgggctttgtcgcgaatatccggcacccagaagaaaattgcggtgagcacggcgatgttgaaaaccgcgatcaataaaaaggtgtagcgccagctaaattcctggctcaggtaagtgccgaacggaatgcccaccagattcgccaccgtcatccctgaaaccatacccgcgacggcggcggtgaccttcccggggcggataatctttgacaagacaatggcgccgacgccaaaaaaggcaccgtgcggaaagccggaaaccagtctgccgacggcgagcatcagatatgacgaggaaaaggtaaatatggcattgcccatcacgcacaacatgaccagaaacaacagtatatgtttaagcgaaaagcggctggaaaagagcgccataacaggcgcgcccagcacgacgccgaaggcgtaaaacgagatcatatgcccggcggcgggaattgttatcccgacatcgcgtgccagctccgtcagcacgcccataatgccaaactcggccatccccagtccgaacgtacccagcgccaaagaaaaaataacttttttcataccacctgccgaaaataaaggcgcatgttgcgcgctgtggctgtgaattgtcacagccaatcaacgtatagcttgcggataagcgcgaggtaataccattccttatccgtctttgtgtattcattattatgctatgtcatgacggtatgctgtgcgcaggatgacactcgtgttactccacggcaaacgctttgtccagtttgctataaccaagcccattgatttttttcacttttatctgcacagggatacgttctttcatggcttccacgtgactaatcacaccgatggtcttcccgctggcattcagcgcatcgagcgcatccagcgcggcgtccagcgtttcgctatcaagcgtgccgaagccttcgtcgaggaacaaagaatcaatgcgcgttttatggctgaccaaatctgataacgccagcgccagcgccaggctgaccaggaaactttcgccgcctgataacgttcgcgtatcgcgcacggcgtcggcctgccaggtatcgacaacctccagttccagcgcgtcgctggctttgcgctgcaataaatagcggccatgcaggcgggtgagctgatgattcgccagccagaccagattatccagcgtcagtccctgggcgaatttgcggaacttatcaccttctttagagccgatcagcgcattgagatagccccagtcttccacttgctgagaggcttgcttcatttccgtcatcagcgcgcgttggcgctgccgattatctgcatcctgtttaatttgctggcggatttccccctggcgtgtcgtgttctcgcgcagttgttgcgccaactgcgtcagccgctgcgcgagctgctccgccgtacacgttgggtccagacctgcgggcggctgttgctgatggtcagccagcgcctgcgcggactgcgcgcttaacgccttcgcttgttgtagctgactttccagcgtttgttgttgtttttccagacgggtcacggtctcttcatccagcaacgccgccaggaacgttgcctggctgtcaaacgggctattttttaacgccgcatcaaagtgcgctatcgcctcggcggcgcgctgctgctcctgcgtcgtttgttcctgcagggtttgcaactggctttgtaatgacacgcactcatcatgcgcctgccgccagttatccagcggcacgtcgtcgtcggaatccgcggtatccgtttgcggtagcgtctccagcaacggggcaagcctgtcgatctgcatttgcaaatccgcgaactctgtctgacgctgttgccatattttcgcttcgtcggcgcgctcattcagccacgaagcctcgtcttctggcgcaggaagggaaagcgtatactgcgccaaatctgccgtcagcgacgcctgacgctgcgcaatctgcgcggtaaagcgcgctacctgttcagtatgcgccgcgatttgcgtttgtagagcatgacgctggctgagctgatccaactgttgctcatgctcttccgcggcggtcagccagcccgcgaggtcttcttgcggctggagctgaacgcccagcgtagcgcacagcgtttgccattcctcagtaagcgcttgctcctcctgcaacaacgactgcgcctcgctttcatcccgctgtaattgttgcgttaaggcatctaactgtcctcgcagcgccgcgccttcttccgccagcgttttgacctctttttccagcgcgtcgcggcgggtttgattcgcgctcagttccagcgcctgataggcggcgatggcggggtgcgtcgtcgagccgcaaagcggacacggctggccggactgtaagtgcgcccgctggctttccagatctttgatgcgcgcctcctgctcgcaaatagtgcgaacgtccgcaagctcctgcgctttagtcttataactcaaacgcttatccgccagacgttgggtgtattgcgcctgctcctgatgatgacgcgcgatagctgcctgtagctgcgcctgacgcttttgtttcgggagaatttgcccctgaagcgcggcgagacgatggcgtagcggacgctgccgggtatgcaatgctctggcttccgccagcgcctgtggcgtgaggtcgagcgtgagcggcggtagcgcatcacgctgacgcgtatcgctcagcaactgctgttgccattggctcagttgcgcccgatcgtgggattgttgtgttaataatgctcgccaccccgccagttcgctgcgccagacgcggatgccgtcgtgttccgccagccatgtcttcaaccgctgccctgtggcgttcagttgcgtgaattgtcgatgcgcgcaggcgcggatacgctggcgcaggcgatacgcgctttgtaagcgagcattcacttcatcactgtgctggcgaacacgctcaacggcgcgggtttgttcctgaatgcgctcccagtgcgggcgcaactggcgagcaggttgcgccagtgtcaacgccgcgagctgcggctgcgctttttctcgcgcctcttgcgccgcgtacagcgcctgctgccgggcgtgtaattcagtgtggagctcgttttttcgggtcagccagtgaaggtgctgctgctgtccctgctggtcggccagcaggcgtttctcttcgtcagtaagcgcctgcaaactggcttccagttgctgtaactgttcgtccgccaatagggcgacgccgctggcctgcgcttgtaacttttccagttcgagacgggctgatttatgtttttcaaatacctgtgcggagatctgcccgtaaatctcagtgccggtgagctcctccagaagctctgcgcgctctttcgctttggcgttaagaaaggcggcgaactgcccctgtgataacaacatcgaacgggtgaagcgcccgtagtccagcccggtcaacgtggcgatcatctccagtttatcctttaccttatcggcaaagatctttccgtctgaacaccgtgccagctctacgcgtggggcctggagattgccgtcaggctgatttcgggctcggttctggctccagaacgcgcgccaggcttcgccttttacctcaaactccacttcggccagacattccgctgtatcgcgcgtcatcaaatcgttttgcgattgcgataccgtattcaggcgcggcgtttcgtggtacagcgccaggcagatggcgtcaagcaaggtggtttttcccgcgccggtcgggccggtaatggcgaataacccgttactggcaaacggttcggcggtaaagtcgaccttccattctcctttcagcgagttcaggtttttcagacgcaaactgagaattttcatgcctcatgctcctcattcaacgcgtagagcgtgctggaaaagagctgattcaggcgctcgcgctgcgggggatctaacgcttccagcgccagacgccgcgcaaaaacctcctccacgctaagctcgcttaatgtttcccgccgctcgttcgccagcgagcgctcgcgctgttcgcggctacggcgcaccagtaatacctctacggggagtgactccgttaatgtctgtattctgcgttggatatcgtgcagataatcatcggtggtgatttcaatatccagccagacggggggcgattgctcaacgccgcgccactgctcaagctgttcggtaattgacgccaggtcgccttttaaaaccgccagcggttgagtcacggggacagccagactttcggtactttgccatttcccctgctcgaaggtcaccagatgcacgcatttgcttttgccgcactcatcaaagctgagggcgatgggtgagccgcaatagcggatatgctccgtgccgccgacacattgcgcgcggtgaatgtgtcccaatgcgatataatccgcgggggggaaatgctgcgccggaaaggcatccagcgtaccgatataaatgtcgcgaaccgcatcgcttttgctggcgccgacggtggttaaatgtcccgtcgcgataaccggcagctttcgttcgccgcgtagctggcacgcttcctgatactgctgttgataataatcggcaatcgcatgaagaagttgctgctgtttctcgctgccggataatcccgcctgactggtaataatgtcgcgcgggcgcaaaaagggaatggggcacagtacggcgcccggagacccgtcgcgacgatgaagtagccgcggcgcatagcccgcgctggcgatcacggttgtattgagaaacgccagaatgtcgcgcgattcgtttagcgtggcgacggaatcatgattaccggccagcaccaccagatgacagcccgtttgctgtaaattaacgacgaaacggttataaagttctcgggcatagcttggaggcgaaccggtatcaaaaatatcgccagcgacaataatggcatccacctgatgggcctgcgcggtctccagcagccagtccagaaaagcctgatgctccgcggcgcggcttttactgtagaaattttgtcccagatgccagtcagaggtgtggaggatgcgcataattgttccatgcaaaaaaagcgtgaacgggattatacacgtcatcccttccatttttgggcgcaatttaccgccggtacacggtaatgcatggtttcaccggtgtcataaatcatcaacatgctgtcaatgccgcctttttttttcataaatctgtcataaatctgacgcataatggcgcggcattgataactaacgactaacagggcaaattatggcgagacgtattctggtcgtagaagatgaggcgccgatccgtgaaatggtgtgcttcgtgctcgaacaaaatggctttcagcccgtagaagccgaagattatgacagtgcggtgaataaacttaatgaaccctggccggatctcatccttcttgactggatgttgcccggcgggtcagggttacagtttattaaacatctcaaacgtgaagccatgacccgggatattcctgtggttatgctgaccgcaagaggtgaggaagaagatcgtgtgcgcgggctggaaaccggcgctgacgattacattaccaagccgttttcccccaaggagttggtggcgcgcattaaagccgttatgcggcgcatctcgccgatggcggtcgaagaggtgatcgagatgcagggactgagccttgatcccggctctcaccgcgtgatgaccggcgacagcccgctggatatggggccgaccgaatttaaattactccatttctttatgacgcacccggaacgggtttacagtcgcgagcagctactcaatcatgtctggggcaccaatgtgtacgttgaagaccggacggtcgacgtgcatattcgccgtttgcgtaaggcgctggagcacagcggccacgaccggatggtgcaaacggtacgcgggacagggtatcgtttttcgacccgcttttaatgccttttccgccagtagaacacaggtttctggcggagaaggctttccattcttgagggagtatgacgcgtgctggaacggctgtcatggaaaaggctggtgctggagctggtgctctgttgcatccccgcgcttatccttagcgctttttttggttatctgccgtggtttttactggcggcggtgacgggactgcttgtctggcatttctggaatttgttacgcctctcctggtggctttgggtcgacagaagtatgacgccgccgccgggacggggaagttgggaaccgctgttatacggtttacaccagatgcagttgcgaaataagaagcgtcgccgcgagctggggaacctgattaaacgttttcgcagtggcgcggagtcgctgcctgatgccgtggtactgaccacagaagagggcggcattttttggtgtaacggtttggcgcaacagatactggggctacgctggccggatgacaacgggcagaatattctcaatctactgcgttatccggagtttacccagtatttaaaaacgcgtgatttcacccgtccgcttcatttggtgctcaataccgggcggcacctggagatccgcgtcatgccttataccgataaacaactcctgatggtggcgcgcgatgtgacgcaaatgcatcagcttgaaggcgccagacgtaactttttcgccaacgttagccatgagttgcgtacgcccttgacggtattgcaaggctatctggaaatgatgcaggaacaggcgctggaaggggcgacgcgagagaaagcgctgcatacgatgcgcgagcaaacgtatcgtatggaagggctggtaaaacaactgcttacgctgtctaaaattgaggcggccccggcgctgttattaaatgaaaaagtggatgtaccgatgatgctgcgggtcgtggagcgtgaagcgcagacgctcagccagcagaaacatacctttacgtttgaggtcgacgatagtcttagcgttctgggcaacgaagagcagctacgtagcgcgatctcaaacctggtgtataacgcggtaaaccatacgccggcgggaacgcatattacggtgagctggcgacgtgtcgcgcatggcgctgagttttgcattcaagataacggtccggggattgctgccgagcatattcctcgtctgaccgaacgcttctaccgtgtcgataaagcgcgttcgcggcaaacgggcggcagcggcctgggattggcgattgtgaaacatgcgttgaatcaccatgaaagccgccttgaaatcgacagttcgcctggcaaaggaacgcgatttagctttgtgctgccggaacgtttaattgccaaaaatagcgattaattgcctttcgtaagtataactttccataagccagcggatgctggcttattttctttgcagttaagacgggctcgttgaaacattcaacgtttggtggttttttgttcgcatgattagccataactttttcatgagaatggtgttttattctggttgtaaatttcatatcgctatattcatctggtttttagatcccaccttgctttaaaacgttataagcgtttaaattgcgcttcaggtgctgtcattacgactgcatttgcgcggtaaatcgaaaaacaattcttcgccgcatcggtccgggagcttttcccgctgaaattgataaaaaacgccgctttataatcctccgggaaaggcaaaaattttaatgtttacaacatcaccatccacaggcagtaagactttatgacccatcagttaaaatcgcgcgatatcatcgccctgggctttatgacatttgcgctgttcgttggcgcaggcaatattatctttcctcctatggtcggtttgcaggcgggtgaacacgtctggacagccgctattggctttctgattaccgccgtagggctaccggttcttactgttgtggcgctggcgaaagtcggcggcggcgtagacagcctcagtacgccgattggtaaagtggcgggactcctgctggcgaccgtttgctatctggccgtcgggccgttatttgcgacgccgcgtaccgcgacggtgtcgtttgaggtcggtatcgctccgttgactggcgattctgcaatgccgttgctgatttacagcgtggtctatttcgctatcgttattctggtttccctctatccgggtaagctgctggatacggtagggaatttcctggcgccgttgaaaattattgcgctggtcatcctgtccgtcgcggctatcgtttggcctgccggtccaatcagcaacgccctggacgcttatcagaatgcggccttttctaacggatttgtgaacggctatctgacgatggatacgctgggcgcgatggtgtttggtatcgttattgtgaacgcggcgcgttctcgcggcgtgaccgaagcgcgcctgttgacgcgttacacggtctgggccggcctgatggcgggcgtggggctgacgctgctttaccttgccttgttccgcttaggttctgacagcgcgacgctggtcgatcagtcagcgaacggcgcggcgattcttcatgcctacgttcagcatacctttggcggcgcgggaagcttcctgctggcggcgctgatctttatcgcgtgtctggtgacggcggtggggctgacctgcgcctgcgctgagtttttcgcgcagtatattccgctgtcttaccgcacgctggtctttattctcggcggcttctctatggtggtgtcaaacctcggactgagccatctgattcaaatctccattccggtgctgacggctatctatccgccgtgtatcgcactggttgtattaagttttacccgctcatggtggcataattccacccgtatcatcgcgccggccatgtttatcagtctgctttttggtatccttgacggcatcaaagcatctgccttcggcgatatgctgccagcctggagtcagcgtttgccgctggcggaacagggactggcttggttgatgccaacggtggtgatggtgatcctggcgattatctgggatcgcgcggcgggtcggcaggtgacctccagcgctcactaaaatcgctgacatatgtgtacaccacggggcttaacgccccgtggttttttattgtgttgataggtcagaaattgatggaaagcaataataagctaaagcgtgggctgagcacccggcacattcgctttatggcattaggttcggcaatcggcaccggcctgttttacggctcggcggacgccatcaaaatggcggggccgagcgtgctgttggcctatattattggcggggtcgcggcatatatcattatgcgcgcattgggggaaatgtccgttcacaaccctgccgccagctcattttcgcgctatgcgcaggaaaacctcggcccgcttgcgggctacattaccggctggacctactgttttgagatcctgatcgtcgccattgccgacgtgaccgcgttcggcatttacatgggagtctggttccccgccgtgccgcactggatttgggtacttagcgtggtgctgatcatttgcgccatcaacctgatgagcgtcaaggtgttcggcgagctggagttttggttctccttcttcaaagtcgccaccattattatcatgattgtcgcgggtatcggcatcattgtgtggggaattggcaacggcgggcagccgaccggcattcataacctgtggagcaacggcggcttcttcagcaatggctggttgggaatgatcatgtcgctgcaaatggtgatgttcgcttacggcgggattgagattatcggtatcaccgccggggaagcgaaagacccggagaaatccattccgcgcgccattaactcagtaccgatgcgtatcctggtattttatgtcggcacgctgttcgtcattatgtctatctatccgtggaatcaggtcggcacaaacggcagtccatttgtgctgacgttccagcatatggggattacctttgccgccagcattctgaactttgtggtattgaccgcctcgctttccgctatcaactccgatgtgtttggcgtaggccgtatgctgcatggtatggcggagcaggggagcgcgccgaaagtctttgctaaaacgtcacgccgtggtattccgtgggtcactgtgctggtgatgacgattgcgctgctgtttgcggtttacctgaactacatcatgccggaaaacgtcttcctggtgattgcttcgctggcgacgtttgcgacggtatgggtatggattatgatcctgctgtcgcaaatcgccttccgtcgtcgtttaccgccggaagaggtaaaagcgctgaaatttaaggtgccgggcggtgtcgtaacgacgatagcgggtctgattttcctggtcttcattattgcgcttatcggctaccatccggatacccgcatctcactgtatgtgggcttcgcctggatagttctgctgttgattggctggatatttaaacgccgtcgcgaccgtcaattggcgcaggcgtagtcgtttttctctgccttatccggtctgcaggcaacggtagaccggataagcggagccgcttctcctcctggagcctcctcccctaataaacccctggatgatgagttatcctttaaatctctgtggcaaggtggccccattttcagtagaggggatacgagatgttgaatgcctggcacttaccggttgccccatttgtgaagcaacataacgataaattaaccattacgctgtggctgagcggagaaaatccgccgtctcgcgtgacgttgcgctcagaattcgataatgaagaaatctcactggcgatgcgcaaacagcgccgccagccgcagccgggcgtgacggcgtggcgagcgacgctcaatatcgcgttagggcaaccccgtcgccgttacagctttaaattgctttggcatgaccgccagctttggtttacgccacagggatttagccgttttccgcctgcgcgtctggaacaatttgcggttgatgtgccggatagcggcccgcagtgggtcgccgatcaaattttttatcagatcttcccggatcgttttgcccgcagccagtctcgtgaagccgggcaggaccgggtgtactaccatcatgccgcaggtcaggagattgtgctgcgcgactgggacgatcctttaaccccccaggcgggcggttccaccttttacggcggctgtctgaatggcatttgtgagaagctgccgtatctgaaaaaactgggcgtcacagcgctatatctgaatccggtatttaccgcgccgagcgtccataagtacgatacggaagattatcgccatgtcgatccgcaatttggcggcgatcgggcgctgctacgcctgcggcgtaaaacccaggtgcagggcatgaggctggtgctggatggcgtgtttaatcatagcggcgactcgcatgtgtggtttgacaggcataaccgcagcactggcggcgcgtgccatcacccggactcgccgtggcgcgactggtactccttttcaccacaaggcgtggcgctggactggctgggttatccgagcctgccgaaactcgattatcaatcagaaacgctggtcgatgagatctatcgcggtgaggacagtatcgttcgtcactggctaaaggctccgtggaatatggacggctggcggctggatgtcgtacatatgctgggcgaggcgggcggggcgcgtcataatttgcagcacgtcgccggtattacccgggcggcaaaagaggcgcagcccgaagcctatattgtgggggaacatttcggcgatgcgcggcagtggctacaggccgatgcggaagatgccgccatgaattatcgcggcttcaccttcccgctatggggatttctcgccaatactgatatcgcttacgaaccacagcatattgatgcccggacctgtatcgcgtggatggataactaccgcgccgggctgtcacatcagcaacaactgcgcatgtttaatcaactcgacagccatgatactgcgcgctttaaaactctgctgggtaaagacgcggcgcgcctgccgctggcggtggtctggctgtttacctggcccggcgtgccatgtatttattacggcgatgaagtcggcgtggacggcgcaaatgaccccatgtgccgcaaaccgttcccatgggatgaacgcaagcaggacggcaacttgctggcgctgtaccagcgtatggcgaaactgcgccagagcagtctggcgctgcgtcgtggcggatgccaggcgctgtatgccgaaggtgacgtagtggtattcgtgcgagtttatcagcagcagcgggcgctggtggcgattaaccggggcgaggcctgtgaagtggcgctggaagcgttgccgttgctgaacgtggccggatggcaatgtaaaacgggaagcggtgatatccgcgagggaagacttagtttacccgcgatttccgcgacggtatggatgaatcgttgaggcgaggtggttcgtaacaccttacgcataaaaaaggctcgcattcgcgagccttttatcaatgcactgacttacaggctggaaatgttctcagccaggtatttagccacgccgtccggagaggcgttcatgccttctttgcctttttcccactgcgccgggcagacatcaccgtgctcttcgtggaactgcagcgcgtcgaccatacgcagcatttcgtcgatattacgacccagcggcagatcgtttacgacctggtggcgaacaataccgttagcgtcaatcaggaaagagccgcgcagcgcaacgccttcgtccgggtgttcgataccgtaagctttctgaatttcacgcttcacgtcggcgaccattgcgtatttcaccgggccaatgccgcctttatcgacaggggtgttacgccatgcgttgtgaacgaactcagagtcgaaagaaacgccgaccacttcaacgccgcgcttctggaattcttcataacgtttatcaaaggcgatcagctcagacgggcaaacaaaagtgaagtccatcggccagaagaacagaacggtcgttttaccattggtgtgctgtttgaagttgaatttatcaacaatctcaccgctacccagtaccgccgcagcggtgaaatccggggcctgacgagtaaccagtaccataataattctcctgcaatattaagggttttagaacgcaacgcgggcagtatagggagggcgaagcgacaaaacaatgcggtcttgacaatcaatgagacagcttttgcctatcgatcgggtcattataaatcgtaatgatgacccttttatgacagcgaacgatctttctgccaacggcggatctgacgcacgccctcgctatcaggccgtcacagcgctttgcgggcggcctgtgccatcatacgcggataaaaatgccagaagcgctcttctaacgcgtcgtagtgcgcgtccagatcgtaccaggaatcacgcaaggcatccagccggggacggcgattcgccatgccattcagcacgttttgaatgaaatccatatcgcgataccgctctaaccatttttctgaccaaagataatcattcaggttgacaaagcgcggcggggagtcgggcagaatcgtcgcgacctgcgcatgggcgtagccgacaaacgcctgaagtggaaaatcgggagagatttgcgtccagtgacgcgataaaaaatgatcccacatgacgtccagcgtaatgggcgccacgcgccgcgtttcatggcggaaccactctcgcgcctcacgaacttccggcaggttgtcggtcatgacgtcaatacgccgatgcatataaataccctctaccacgtcaggaggataatgcgttgccgggttaccgcggacaaaatcggccagaagattaccggaaagcgagctgtcggcaaggtgcgccagatgcaggtgagcaagaaaattcattattgattctctgtccaaaaagcgggtaacggttgcagcgggaacgccccggcactagactacccgcctcttattttagtctgagtcagagtcatgcgcgttaccgatttttcctttgaactacccgaatccctgattgcccactacccacagccggaacgcagtcgctgccgtttgctgtcattagaggggccgacgggcgcgctgacgcacggtactttcaccgatctgctcgataagctcaaccctggcgatttgctggtcttcaataatacccgcgtgatcccggcgcggctctttggccgtaaagccagcggcggcaagatagaagtgctggtcgaacgtatgctcgatgataaacgcatcctggcgcatattcgcgcttctaaagcgccaaaaccgggtacggaactgctgctgggcgacgacgaaagtattcacgcgaccatgaccgcgcgtcacggcgctctgtttgaagttgagtttaatgacccgcgtccggtgctggatattcttaacgccatcggccatatgccgttgccgccgtatatcgaccgtccggacgaggacgccgaccgcgaactgtaccagacggtctacagtgaaaaaccgggcgccgtcgccgcgccgaccgcggggctgcactttgatgagccgctgctggcggcgcttcgtgagaaaggtgtcgaaatggcgtttgttacgctacacgtaggcgcgggcactttccagccggtgcgtgtcgataccattgaagatcacatcatgcactccgaatatgctgaggtgccgcaagaggtggtcgacgcggtgctggcggcgaaagcgcgcggcaaccgcgtgattgctgtcggcaccacctcggtacgctcgctggaaagcgcggcgcaggcggcaaaaagcgatttgatagagccgttcttcggcgatacgcaaatctttatttatccaggttatcaatacaaagtgattgatgcgctgatcaccaacttccatctgccggaatcgacgttgattatgctggtttccgcatttgccggttatcaacacaccatgaatgcctataagactgcggtagaacaaaaatatcgcttttttagctacggggacgcgatgtttatcacgtacaatccgcaggctatttctgagcgtccgtaagaaggctatctcacttgccattttgacgccgggcagtgctcgccatcctcacgtactgcgtgtacgctccggtggctgtgcgctggtcgaccccaaactggctgcgccgatgacgtcttcgggaatttattagctatggaatcattccgtagcgagtcgttaaacgtcggactgtttttctgacgcaggagtgataatgaaatttgagttagataccaccgatggtcgtgcgcgtcgcggtcgtctggtgtttgatcgtggcgtagtggaaacgccagcctttatgcctgtgggtacttacggtaccgtgaaaggcatgacgccggaagaagtggaagcgaccggcgcgcagattattctcggcaacactttccacctgtggctgcgcccgggtcaggaaatcatgaagctgcatggcgatctgcacgattttatgcagtggaaagggccgattctcaccgattccggcggcttccaggtcttcagcctcggcgatattcgtaagattaccgagcaaggcgtgcacttccgtaacccgatcaacggcgatccgattttcctcgatccggaaaagtcgatggagatccagtacgatctcggttccgatatcgtgatgatctttgatgaatgtacgccgtacccggcagactgggactatgctaaacgctcgatggagatgtcgttgcgttgggcgaagcgtagccgcgaccgttttgatagccttggcaataagaatgcgctttttggcatcattcagggcagcgtttacgaagatttacgcgatatctcggtgaaaggtctggtagagattggctttgatggctacgctgtcggcggtttggctgtcggtgagccgaaagcagatatgcaccgcattctggagcacgtttgcccgcagatcccggctgacaaaccgcgttacctgatgggcgtgggtaaaccggaagatctggtggaaggggtgcgtcgcggtattgatatgtttgactgtgtcatgccaacgcgaaatgcccgtaatggtcatctgtttgtgaccgacggcgtggtgaagattcgtaatgcaaagcataaaagcgacaccagcccgcttgacgccgagtgcgattgctacacctgtcgcaattattcacgcgcttacttgcatcatctcgaccgttgcaacgaaatattaggtgcgcgtctcaataccattcataacttgcgttactaccagcgtttgatggcgggtttacgcaaggctattgaagagggtaaattagagagcttcgtaaccgagttttaccaacgtcaggggcgacccgttccacctttgaacgttgattaattttaataatgagggaatttgaatgagcttttttatttctgatgcggtagcggcaacaggtgctccagcgcagggcagcccgatgtctctgattttaatgctggtggtgtttggtctgattttctatttcatgatcctgcgcccgcagcagaagcgcaccaaagagcacaaaaagctgatggactccattgcgaaaggtgatgaagttctgacgaatggcggtctggtcggtcgagtgaccaaagtagcggaagccggctacattgccatcgcgctgaatgacaccacggaagtggttatcaaacgtgacttcgtagctgccgttctgccgaaaggcaccatgaaggcgctgtaatatttcgttttcccaaagggaactgccgtgttaaaccgttatcctttgtggaagtacatcatgctggtcgtcgtgattatcgtcggcctgctttacgcacttcccaacctgtatggtgaggatccggctgttcaaatcactggcgtgcgcggcgtcgccgccagtgagcaaacgctgatccaggtccagaaaacgttacaagaagaaaaaattcccgctaagtctgtggcactggaagagggcgctattcttgcgcgcttcgacaccaccgatacccagctacgcgcccgtgaagcgctgatgagcgtgctgggggataaatatgtcgtggcgcttaaccttgcgccggctacgccgcgctggttggcggctattcacgccgatccgatgaagctcggtcttgatctgcgcggcggcgttcacttcctgatggaagtggatatagataccgcgttaggtaaactccaggaacaaaatatcgatagcctgcgcagcgatctgcgtgaaaaaggcattccttataccaccgttcgtaaagaaaataattatgggttgagcatcacgttccgtgacagcaaagcgcgtgatgaggcgatcgcctatctgacgccgcgtcatcgtgacctggtgatttccagccagagcggtaatcaacttcgcgcggtaatgaccgatgcgcgcctgagcgaagcgcgtgaatacgccgttcagcagaacattaatattctgcgtaaccgtgttaaccaactgggcgtcgcggagcctgtcgtacaacgccagggcgcagaccgtattgtggttgagctgccgggtatccaggataccgctcgcgcgaaagaaattctcggcgcgaccgcgacgctggaattccgtctggtgaataccaacgttgaccaggccgccgctgctgccgggcgcgtaccgggtgattccgaagtgaaacagacccgcgaaggtcagccggtggtattgtacaaacgcgtgatcctcaccggcgaccatatcaccgactcgacgtccagccaggatgaatataaccaaccgcaggttaacatctcgctggatagcgcaggcggcaatatcatgtctaacttcactaaggacaatatcggcaaaccgatggcgaccctgtttgtggagtataaagacagcggtaagaaagacgctaacggtcgcgccgtactggtgaaacaggaagaagtgattaacattgccaacatccagtcccggctgggtaacagcttccgtattaccggtatcagcaacccgaacgaagcgcgtcagctctcgttgttgctgcgtgcgggcgccctgattgcgccgattcagatcgttgaagagcgcaccattggcccgactctgggtatgcagaacatcaagcagggcctggaagcctgtctggccggtctggtggtctccatcctgttcatgatcttcttctataagaagtttggtctgattgcgaccagcgcgttagtggctaacctagtgttgattgtcggtatcatgtcgctgttgccgggggcaacgctcagtatgccggggattgcgggtatcgtgttaacccttgcggtggcggtcgacgccaacgttctgattaacgaacgtatcaaagaagagttgagtaatggccgcacggtacagcaggcgataaacgaaggctatgccggcgcgttcagttccatcttcgatgcgaacatcacgacgctgattaaagtcatcattctgtatgctgtcggtaccggggcaattaaagggttcgcgattacgaccggtatcggtgtggcgacgtcgatgtttaccgcgattatcggtacgcgtgctatcgtaaacctgctatatggcggcaagcgcgtcactaagctgtcaatctgaggagtgcgatgtggcacaggaatacactgttgaacaactaaaccacggccgtaaagtctatgactttatgcgctgggacttctgggcattcggcatctccgggctgttgctgatcgcggccattgtcattatgggcgtacgcgggtttaactgggggctggatttcaccggtggtacggtaattgaaatcacgctggaaaaaccggctgaaatggacgtgatgcgcgaagcgctgcaaaaagcgggctatgaagagccgcagttgcagaactttggcagcagtcacgacattatggtgcgtatgccgccaaccgaaggtgaaaccggcggtcaggtactgggtagcaaagtggtgacgatcattaatgaagccaccaaccagaatgcggccgtgaagcgtattgaattcgtggggccaagcgtgggcgccgatctggcgcaaaccggcgctatggcgctgctggtggcgttgatctctatcctcgtttatgtcggtttccgctttgagtggcgactggcggcaggggtggtcatcgcgctggcgcacgacgtgatcattacgctggggatactgtcgcttttccatatcgagattgacctgaccattgtggcatcgttgatgtcggtgatcggttactcgctgaatgacagtatcgtggtctctgaccgtattcgtgaaaacttccgcaaaatccgtcgcgggacgccttacgaaatctttaacgtgtcgctgacccagacgctacaccgtacgttgattacctccggtacgacgttagtggtaattctgatgctgtacctcttcggcggtccggtactggaaggcttctcgctgacgatgctgatcggtgtctctattggtacggcatcttctatctatgtcgcatcggcgctggcgctgaaactcggtatgaagcgcgagcatatgctgcagcagaaagtcgaaaaagaaggggcggatcagccgtccattctgccgtaaacacgtatttaagtgttatctgaatcccggtcatgcgatcgggatttttttatttatgtaccatgacgataaacattactgacagtatgctgtcaggagccctgtcatacactcctcatgaatttacccacactcgcaggaggatgtatgaaaaacttgattaactggtttgaaattccagttactgatatggcgcgtgcaatcgccttttatgagcaagtgatgcagatatcgttacgtcgggaaaccatggatggggcggacctggccgtattcccgtatgctgaacccggacccggcggagcgctgataaagcaggatgatgtcgctccagttgcgcagggagtcgttatttatctgcataccgccgatttgttagcctcgattgaacgtgtcgtccttgccggtggcaagtgtgttctggaacccatggttcccggagatgacattggaaccatcgcgttgtttattgacagcgaaggcaaccgaataggtttacatcaacctgcgtgatatttgctaaatgtagagagtcaatatgaccagacgcgctgaccgtttgtttcagatcgtgcaaattttgcggggtagacgactgacgacggcagcgctgttggcacagcggcttgcggtttctgaacggacgatttatcgcgatattcgcgatctgtcgttatccggtgtgcctgtcgaaggtgaagcggggagcggataccgtttaatggcaggttttgatctgccacccttgatgcttacccatcgtgaatcggaagcactgatggtggctatacggttattgaaaacctggggcggcgattcgctatcacgcgagcttgaatccgcccaggaaaaagtgttggccattttgccggaagagagccgccgtaaagcggagcagacacggatttacgctccggatttgggtacatctccacattcgcgcagcgcgtttgatcttatccatcaggccgtttcggcgcagcaggtgttggcgctacattatcgtgatgaagcggggcatctctcttcgcgggatatacaaccgctgggattgtttttctggggagagcactggctgctggttgcctggtgtgagagacgggaagactatcggtgttttcgcctcgatcgctgtttacaaattactccgcttaaccggcgatttcgtgaaacaatcgaccgttctttgcgtgattttttgcgaaaagtcgagcacgaaaaaatgccgtaagatgtgatagcgatacctctaacgcttgtaaaacgggttgattggtcatcagtttgcctgaaatagccttgcttacctggatatataagttgcacagaatcattgctaaaagcccggcttcgcgggaaactgggcataaccctttgtattattcaggtacctgttaattatggctatcatcccaaaaaactacgcgcgcctggaaagcggctatcgtgaaaaagcgctgaagctgtttccgtgggtgtgcggacgttgttcccgtgagtttgtgtattcaaatctgcgtgagctgacggtgcatcatatcgatcatgaccacaccaataacccggaagacggcagcaactgggagctattgtgcctctactgccacgatcatgagcattctaaatataccgaagccgatcagtacggttcgacggtcattgccggggaagatgcgcaaaaagatgtcggcgaggcgacttataacccgtttgccgatctgaaagcgatgatgaacaaaaagaaataagcagactgctgacaaagctgttggtgctgttgaatgttaggttacgcttcgctccacccaacggaatccgcaatataaatgaattattggttttcgtaggtcggatgcaatctggcattttttcagccccggagtttgtcgccagccccaaatgtcctgtaacgcatacattgtcactggaatcccgatcgcaaggttgggatttttttgtttttaagtcctgccgatactggcgagcagagtagaatcagcggtaagccggggcaacccggtgaggcgcaatgttgcgggggcttgatccccggtggccttgtcgctggaaagagaaaacccccgcacattgttcggtattcaccggcaacattacgggggctaacttgactccagacaagttgaggatagccgcgaaccgttgccattgcaacaaaggcggcaatatgacgctcacagagttgagcattactatctggcacgatctggcggcaccaacgctggtcgggattgcgacaggtctgtttttaggctggtggcatcgccggaagtaatgtgaagtgggcgcgactcgccgccgcatggcagcatgcgcccgaaacgggccagaggacgacctctggccttttttgcaggtttagaagttgtaacccacgaccaggtagccgccccagccggtagatttcgcgctgaaatcgccgtcgccccagttcagttttgcgccattctgccactgtccgccgttatggaagtaacgcgcaacgaccgagtagtgccagtgatcgtagttcagcgccaggatatggctggaagcgatggagttgctggtacggttcggatcgtcgcctaaatcagatccccagtcaaagttggtaaagccgatatagctcagtttaccgccccacagatcggtgatggggacgaagtatttcactttgaaacggtagccgtcccattcgttttcattggacgcgccgtagttttgccactgatatttcgcatacacgttcagcgacagacccatcggcaggccggtgtcgatatcggtccccagacccatataccacgtgctctggcggctggctttgttatcgcccatatcgtagatgtagttgttggcgaaataccactctttaaacgggccgaagctcaggtctgcgccggtcagcttatcaattgagaaacgcggttcgatttccatgaacagcggagaaccgtcggaccagatacctttatcgttgccgttaccccaatcaaaggttttgggaatatcgatatagccgtagaaatcaaaccagtcttttttggcaaatgcttcatattccagatagacgtcgttgttcaatttcggcgagaaacgggtatggtagctgcctaccacgtttacgctctggtgccaccagtcggacaaatactgcggctgatcattttctgctgcgttagcagtaaaagatgaggtgagcgccagcgctgcgctgactgcgagtaaagtttttttcatatgtatgccactgtttgaaatcccttgcgggagtgaaaagaacgcaatttgcgtttctaaatatttcgtgtttctgcggagcctattataaaaatcattgctcacaaaaatatgtcttgtttcacatatctatcatttacgtaatcgattgcgttcacgtttgcgcattttagacgcggcgacagtactatctttcatgaatattaccaatccatgtcataaatgacggaaatgtcagtagggcaacaaaagtcgcgcgggggatgttgcggaacgcacaaaacgctccgccagaacgtttattgattaacaggctgaatatcatggatgcgaatgaagcctaactgcgccggtgtgatccccttcaacggtaacgaaatattgacatcactgggcgccagcaagctggctggggcatttaccagaaggctctgtgcattcacctcctgatagttctccgtagtgccctgaagttgcccgtactctacggtagcgctgaatgccggcagtggatcgcgggactcgccctgaatgtgtaacgttgcgtgagcgccgtctgcgacaggcgtaatttccagcaatgtcatacgtagcgtaccgatctggctctccagccgggcaggcgtattggcgccaggcaacaaatagacgccgcgggttgactccgcattcagcttattttgttgggtaatttttaccgtttcctgattcagttgggtcatctctttattcagggtgctaatgctttgatgcatctggcgaacttcgctctgcggcgcgcaggcggtcaggctcaagagacttcccaccaggagaattcttaggtaacgtcttgtcatgtcgatcatttccttcatggttcgatagcgtaatggtagtgcgctatacgcacaaaggcaccgatcctttatctcaaaagcgctccgcctttgttgtcgcgccagttcagggtaaaataacatttcctaaatcatctggtcaggacgccgtatgcattgcccattttgtttcgccgtagataccaaagtcattgactctcgtcttgtaggcgagggctcgtccgtgcgccgccgtcggcagtgcctggtgtgtaatgaacgctttacgaccttcgaagtggctgaactggtcatgccgcgcgtgataaaaagcaacgatgtgcgcgaaccctttaatgaggataagctgcgtagcggcatgttgagagcgctggaaaaaagacccgtcagcgcagatgatgttgaaatggcattgaaccatattaagtcacaattacgtgccactggggagcgtgaagttcccagcaagatgattggcaacctggtcatggagcagctgaaaaaactcgataaagtcgcgtatattcgctttgcctccgtctatcgcagtttcgaagatatcaaagactttggcgaagaaatcgctcgcctacaggactaagccatgcaggatgagttttacatggcgcgagcgctcaaactggcgcagcgtggacgtttcaccactcaccctaaccctaatgtcggctgtgtcattgttaacaatggcgacatcgtcggcgaaggttatcaccatcgcgccggagagccgcacgccgaggttcatgcgctgcggatggcgggcgcaaaagccaaaggcgcaaccgcctatgtcacgcttgaaccctgtagccatcatgggcgaacgccgccatgttgcgatgcgctgattgcggccggcgtcgcgcgcgtggtcgccgcgatgcaggacccgaacccacaggtcgccgggcgtgggctgtatcgcctgcaacaggcgggtattgcggtcagccacgggttaatgatgagtgaagcggaggcgctcaataaaggcttcctcaagcggatgcgtaccggattcccttatcttcagcttaaactgggcgcctccgtcgacggacggacggcgatggccagcggcgaaagccagtggatcacctcgccgcaggcccggcgtgacgttcagcgcttgcgtgcgcaaagccacgctatcttaaccagtagcgcgacggtattggctgacgatccggccttgacggtgcgttgggcggagttagacgcctctacgcaggcgtcttacccgcaggaaaatctgcgccagccggtgcgaattgttatcgacagccaaaaccgggtaacgcctgcgcatcgtattgtgcagcagcctggcgaaacgtggatcgcgcgtacccaggaagatagccgcgcgtggcccgatgcggttcgtactatcagcgtgccggcgcacaacggacatttggatctggttgtgctgatgatgcagttaggcaggcagcagattaatagcatatgggttgaagccggaccgggactggcgggcgcgttgctgcaagccgggctggtggatgaactgattgtctatgtcgcgcctaaattgttgggaacccaggcgcggggattatgcgaattgccggggcttgagaagctcgccgacgcgccgcaatttaccttcagcgaaatacgtcatgtcggcccggatgtttgcctgcatatggtgagcgcatgagttctcccgtcgaaaggggagcagcgctcaaattattatgataaaatccgcccccctgcggggccaaatgaaccctggaagagagaatatgaacattattaaagctaacgttgcagcccctgacgctcgtgtcgccatcactattgcgcgtttcaatcagtttatcaacgacagcctgctggatggcgcggttgatgccctgacgcgtattggtcaggtaaaagatgataatattaccgtagtgtgggtgcctggcgcctatgaactgccgctggcgaccgaagcgctggcgaaaagcggtaaatacgacgccgtggttgcgctgggaaccgtgattcgcggggggactgcgcactttgaatatgtggcaggcggcgccagcaatggcctggcaagcgttgcccaggacagcggcgtgccggtagcctttggtgttctgaccaccgagagtattgaacaagccatcgaacgtgctggtacaaaagccggtaataaaggcgcagaagctgcgctgaccgcgcttgaaatgattaatgtattgaaagccattaaggcctgattttttgtaaggggaattccgtgaaacctgctgctcgtcgccgcgcccgtgagtgtgccgtccaggcgctttactcctggcagttgtcccagaacgacatcgctgatgttgaataccagttcctggcggaacaggacgtaaaagacgtcgacgttctctatttccgtgaactgctatccggggtggcgactaacagcgcgtacctggatggtttaatgaaaccgtatctgtcccgcctgcttgaagagctgggacaggttgaaaaagccgtgctgcgtattgcgttgtttgagctgtcaaaacgcagcgatgtgccttataaagtggccatcaacgaagcgattgaactggcgaaaacctttggcgctgaagacagccacaaattcgtcaacggcgtactggataaagcagctccggtgattcgtcccaacaaaaagtgattcacaggccggaaagatagcgggcgctcgatacccgccgtctccggccttttctttttttctgctgaggcataacgtatggcatgtggcgagttttccctgattgcccgttattttgaccgtgtaagaagctctcgtcttgatgttgaaaccggtattggcgacgattgcgcgctcctgaatattcctgaaaagcagaccctggcgatcagtaccgatacgctggtggcgggcaaccacttcctccctgatatcgatcctgccgatctggcttataaagcgttggcggtgaatttaagcgatctggccgcgatgggggccgacccggcctggttaacgctggcgttaacgctaccggaagtggatgagccgtggctggaggcttttagcgacagcctgtttgcgctattgaattactacgatatgcagctcattggcggcgacaccacgcgtggaccgctgtcgatgacgctgggtatccacggttatatcccggcagggcgcgcgctcaagcgatctggcgcgaagccgggcgactggatttatgtcaccggtacgccgggcgacagcgctgccgggctggcggttttgcaaaaccggctacaggtgtcggaggagaccgatgctcactatttaattcaacggcatttacgtccgacgccgcgtattttacacggccaggcgctgcgtgacatcgccagcgcggctatcgatctttccgatggtctgatttccgatctggggcatatcgtcaaggccagcggctgtggggctagagtggatgttgatgcgttgccaaaatccgatgcgatgatgcgccatgttgatgacgggcaggcgctgcgttgggcgctttccggcggcgaagactatgagctgtgctttacggtgccggaactgaaccgtggcgcgctggatgtcgccattggtcaactgggtgttccctttacctgcataggccaaatgagcgcagatattgaagggctgaattttgtacgtgacggaatgcctgtcaccttcgactggaaaggatatgaccattttgccacgccataaagatgttgcgaaaagtcgcctgaatttgcgcaatccgtggcacctgctcgctaccggctttggcagcgggctgagccccgtggtgccgggcacgatgggctcgctggcggcgatccccttctggtatttgatgacgtttctgccgtggcagctttattcgctggtcgtgatgtttgggatctgcattggcgtttatctttgccatcagacggcgaaagatatgggcgtacacgaccacggcagtattgtctgggatgaatttatcggtatgtggataacgctaatggcgttgccgacgacggactggcagtgggtggctgccgggttcgttattttccgcattctggatatgtggaaaccctggccgatccgttggtttgatcgcaacgtgcacggcggcatggggattatgatcgatgatatcgtcgccggggtgatatccgctggcatactgtattttatcggtcatcactggccgctcggtattatttaaagggtttgccggatggcggcataaacgccttatccggcctgcccctgaacaatatgtcgatttcgcaggcccgataagcgccgcgccatcgggcaatggcagattatttaaatcccactaccggatgctgtttgtacggcgtttcgagttcggcaatctgctccggtttgagcgttaaatcaacggcattcagcaactcatctaactgttcttcacgcgaagcgccgataatcggcgcggcgacgcctcgtttgctgagcagccagcccagcgcaacctgcgcccgcgttgcgccaagcgcctcgctgacgccagccagccgttccgctatttgcgcatcatttttatcgctttcatcgtataaatttttacccacgtcatccgagaccaggcgggccgtggtttctccccaggggcgagttaagcgcccgcgcgccagcggactccacggaatcacggcaacgccttcctgccagcacagcggtagcatctcacgctcttcctcgcggtagatcaggttatagtgatcctgcatggtgacaaacggcgcccagccgtgttgtttttgtagcgccagcgcctgggcaaattgtgaggcgtgcattgaggaagcgccgatatagcgggctttacccgcctttaccacgtcgtttagcgcttccagagtttcttctatcggcgtggtgtaatcccagcggtggatttgcaggatatcgacatactccattcccagacgggcgaggctatcgtcaatagagcgcaggatttgtgcgcgggacaatccttccggcagatcgccgacgcgatggaagactttcgtcgctaccaccacctcgtcgcgccgggcaaaatcacgcagcgcgcgaccgacaatctcttcgctgctgccgtcggagtagctgttggcggtatcaaaaaagttaatgccgccctcaagagcgcgcttgatgatgggacggctgctctcttcgggaagcgtccaggcgtgattgccgcgacttggctcgccgaatgtcatacagcccagacaaaggcgggatacccgaagatctgtatttcctaacgtgttgtattgcatgactccgctcctgttatacccgtcactcttcaagcatagcaggagcaaagaggggattatgccagccaggccttgattttggcttcaatgcctgcggcgtcaagccccagttccgcgcgggcttcttcctgcgttccttgcgggataaagaaatccggaagaccgatattcagcacaggtacaggtttacgatgggccattagcacttcgtttacgccgctgccagcgccgcccataatggcgttttcttccagcgtcaccagcgcgtcatgctgcgcggccatctccagaattaacgtgtcgtccagcggcttaacaaagcgcatgtcgaccagcgtggcgttcagcgcttcggcgactttcgccgcctcaggcattaaggtgccaaagttcagaatcgccagtttttcgccatgacgcttcacaaggcctttaccaataggcagtttttccagcggggttagcgccacgccctgcgcattaccgcgtggataacgtactgccgtcgggccgtcgttatagtgatacccggtaaataacatctggcgacattcgttttcgtcgcttggcgtcatgatcaccatatccgggatgcagcgcagataggagagatcgaacgcgccctggtgtgtttgtccatccgcgccaacgataccggcgcgatcgatggcgaacatgaccggcagtttctggatagcgacgtcatggatgacctgatcgtaggcgcgttgcaggaaagtagagtagatcgccacgacgggcttatagccgccaatcgccagacctgcggcgaaggtgacggcatgctgctcggcgatggcgacgtcaaaatagcgatccgggaatttacgtgaaaattccaccatgccggaaccttcgcgcattgccggggtgatcgccatcagcttgctgtctttggcggcggtttcacacagccagtcaccgaagatttttgaataaccgggcagaccgccgctgcttttcggcaaacatccgctggagggatcaaatttaggcaccgcatggaaagtgatcggatctttttccgcgggctcatagccgcggcctttcttggtcatgatatgcaggaactgcggccctttcaggtcgcgcatgttcttcaatgtgctgataagccccatgacatcgtgaccatcgaccggcccgatgtagttaaagcccagctcttcgaacagtgtgcccggcacaaccatgcctttaatatgttcttcggtacgcttgagcagttctttaattggcggtacgccggagaagaccttttttccgccttcgcgcagagaagagtaaagcttaccggaaagtagctgcgccagatggttgttgagcgcgccgacgttttccgaaatcgacatttcattgtcgttcagaatgaccagcatgtcgggccggatatcgcctgcgtgattcattgcttcaaacgccataccggcggtgatggcgccgtcgccaatcacacagacggtgcggcgatctttgccttctttctccgccgccacggcaataccgataccggcgctgatggaggtggaggaatgcccaacgctcagcacatcgtattcgctttctccgcgccacgggaacgggtgcagaccgcctttctggcgaatggtgccgattttgtcgcgacgaccggtaaggattttatgtggataagcctggtgtccaacatcccagattagctggtcaaacggggtgttgtagacataatgcagcgccacggtaagttctaccgtgcccagcccggaagcgaaatgcccgctggaacggcttacgctgtcgagtaagtagcggcgtagctcgtcgcagagtttcggcagactctctttcggtaacagtcgtaactcctgggtggagtcgaccaatgccagggtagggtatttggctatatcaaaactcatcgcaagctcattggatatggggtttatttatcacgctggattatgtagttcgctagcgcttccagtgccgaggtgtccagtgattgcgcggccagctgatgtaacgactgacgggcgtcctctatcaggtcccgggctttattccgggcttgctcaagacccagaagtgcagggtaggtacttttgccaagctgctggtctgcgccctgacgtttacctaacgttgcagtatcgcccaccacatccagaatgtcatcctgaacctggaaggcaaggccgatactctctgcatagcggtcaagtatcggcagagtattccgtcctttatcgcccgcgctcaatgcgccaagtctaacggcggcgcgaatgagcgcgccggtcttatggcgatgaatgcgttccagcgcgtccagagtgatccgctggccttctgccgccagatccaatgcctgaccgccgcacataccggcgataccgctggcgtttgccagttcggcgatcatcgcgatacgatcgcgatcggcgacttccggcatcggcgcgtcgctgataatggcaaacgccagcgtctgcaacgcgtctcccgccaggattgcgttggcttcgccaaatttaatatggcaagtcggcaggccgcgacgcaaatcgtcatcgtccattgctggcaggtcgtcatggatcagcgaataggcatgaatgcattcgaccgccgcagctggcgcatccagcgttgccgtactgacgccaaacatttgaccggtggcgtaaaccagaaatggccgcaggcgtttaccgcctaataatgcgccatactgcatggcttcgaccacgggagtgttctgaaagggcagtggcgcgataaaacggctcagcgcctgattcgcttgcgttacgcaagcctgtagctgctgcgtaaagtccatttactcattatccgcgataaaaggctcaggtgaagcctcttcattatcagacagcaaaatttgcacgcgctgttccgcctgctgcagttttgcctgcccctgacgcgccagttgtacgccgcgctcgaattcattcagcgcgtcttccagcggcaaatcgccgctttccaggcgggtaacaatatgttccagctcgctcagcgcagtttcaaagctggcgggcgcctcatttttcttcggcatgatgactgtttgactctctgtaatggcagtacaagtctatggtaacggactcacactgataagcaaataacgcgcaatggtaaggggaaatgcgcaagatgtccgtgatagtgatatacttccgcgcctggatgcagccgtaggtatgggctgctgtactatttctccacgacaagccttagatagcttgctaaagaaccattgccgccatgaagtttatcattaaattgttcccggaaatcactatcaaaagccaatctgtgcgtttgcgctttataaaaattttaaccgggaacatccgtaacgttttaaagcactacgatgagaccctcgcggttgtccgtcactgggataacattgaagttcgcgccaaagatgaaaaccagcgtctggtgattcgcgacgcgctgacccgcatcccggggattcaccatattcttgaagtcgaagatgtgccgttcaccgatatgcacgacattttcgagaaagcgttggcgcagtatcgcgaacagcttgaaggcaaaaccttctgcgtgcgggtaaaacgtcgcggtaagcatgagtttagctccattgaagtggagcgctatgttggcggcggattaaatcagcatattgaatcggcgcgcgtgaagctcactaacccggatgtgacggtgcatctggaagtggaagatgatcgcctgctgctgatcaaagggcgttatgaaggtattggcggtttcccgattggcacccaggaagatgtgctgtcgctgatctccggcggttttgactccggcgtctccagctatatgctgatgcgtcgcggctgtcgcgtacactactgcttctttaaccttggcggcgcggcgcatgaaatcggcgttcgccaggtggcgcattacctgtggaaccgctttggcagctcccatcgcgtgcgttttgtggcgattaacttcgaaccggtggtcggcgagattctggagaaagttgacgacggccagatgggcgtggtgctcaaacgtatgatggtacgcgcggcgtcgaaagtggcggaacgttacggcgtacaggcgctggtgaccggcgaagcgctgggccaggtatccagccagacgctaaccaatttgcgcttgatcgataacgtgtctgacacgctgatcttgcgcccgctgatctcttacgataaagagcacattatcaacctggcgcgccagattggtacggaagattttgcccgtacgatgcctgaatactgtggcgtgatttcaaaaagtccgacggtgaaagccattaaagcgaaaattgaagccgaagaagaaaacttcgacttcagtattctcgataaggtggtagaagaagcgaacaacgtcgatattcgtgaaatcgcccagcagacccagcaggaggtggtggaagtagaaaccgtgagcggtttcggcccgaacgacgtgattctggatatccgttctgtggatgaacaggatgacaagccgctgaaagtggaaggtgtggacgtcgtttcgctgcctttctacaagctgagcactaaatttggcgatctcgatcagagtaaaacctggctgctatggtgcgaacgtggcgtaatgagtcgcctgcaggcgctctatctgcgcgagcaggggtttgccaatgtgaaggtgtatcgtccgtaattcctttgccgggtggcggctatgtcctacccggcctatcgttttatttctgccccaaccgttttgcaatgcgctccagcttcatcatcagcagcagcgtaatggccaccagcacaatggtcagcgccgcgccgtcggcgatatttccacggtcggtcaagctaaagatagccaccggcagcgtcgtccagcccggcggataaatcatcatcgtcgcgcccaactcccccatggagagcgataaactcagcgccagcgctgacatcatccacggcatcaataacggcaacgtcacgtgacgcagacgataccagggcgatgcccccagactcgacgcgacgttttcaatatcggcggaaattcgcgccagtccggtcgacacgttactgaaggtaaaggcggaaatcagcacaaagtgcgctgtcagcacaatccatagggtgccgttcatttgcaatggcccctggctgaaagcaaccagaatgcccaggcccacggacactgacggaatcgcactcggcagatagaacaccatacttaaccatttctgcgttttcaccccatattgacgcagcgccagcgccgcccaaacgccgcaaagcagcgcaaacaggctggcgcaaaagccaatcgtgaggctggcaagtagggcatcccatgccgcaccgtgcagagcgttaacaaagtggttcagcgtgaagccactcggcagaataccgttccactgctggctaaggctggacatcagaatcaccgccagcggcaggaaaaagaacacgataaacagtacgctagccacaacgcccgccgctgcgcgtcctttaggtgaccaaattagcatggctagctccttacgccggtacgcgatgccgccaggcgatagagggagaacagccccagcgacaagacaatgttaatcaacgcaatcatgcaggcgaccgtatagtcggactccagaatcgctttgctgtaaaccatcatcggcagggtgttaacccctttcgcgccaataaacagtacgatgccgaactcgttagtggtcaacagcaggcacaggctgccaccagccatcagcgccggtagcgcagccgggaaaatcacctgcccaatcacccgtaacgggtgcgcccccagaatactggctgcctctagctggcttttatcaatttgccgcagcgcggccatcagtggccgcatcaccagcggagtgaacaccgtgatctccgccagaatgacgccctgcatcgagtagagaaaatccaccggcggtagctcaaaggcaaacaggctcatcagcgtaccgttgagcagacccgctgacccataaataaaggtgaacgccagcgtaatcaggaaggtcggcagcgcaataaaagtatcgacgacccgaccaatcaactcgctgccggggaaaggaataaacaccagaatcagcgacatcacgctgcccagcagcaggcaaccggcggtggcgaaaaaggcgatttgcaacgtgttcagcaacgcgccgacaaagcgtttcgagtcgaccacctggcggaaggtctcgagcccgatctcgccattggcaccgcgtagcgcctgttcaacgatgagcgacagaggccagaaaaacagcgtcgccagcaccagcaacgggagcagcagccacagcagcgggcgtaggttaagcgccggtttttccagaggtaaaatgagtgacatggttatacctcaatcaggaccgcatcatccggttcgaaccacagcgccagcttgtcgcccacgcgcggcagcggattgacatgcgtcaacaccatccgcaccgtttcgccagcaacgtcacacagcagatgggttaaatcgccctgccagtgcaccgattgcagtgtggcgttgaagcggttgctgtaggccgaacgcggcgtcaggctgaggtgctgaggacgaatgcacagcagtttgttgtaaccgtggtggctgccccggctgaacgcgcgaatcaccgcaccgccgcagctgacgtccaccagccccggagcctccgttatccccagcgcgatggcggagagaatattggcgcgacctaagaattcggcggcaaaacgattgggcggatgctgatatagcgcgcgggtttcgccgtgagcaatcagcgagccatccttcataatgccgattttatcggccagagtgagcgcttccgtttgatcgtgggtgacgtagagaatagtgagttccggcagctcacggtgaagacgggcgatttcttccaccatattatgacgaatctgtgcgtccagcgctgacagtggttcatccagcaacagcacgcgcgggcgcacggcaatcgcgcgggcgatggccacgcgttgctgctggccgccggaaagttgatgcggataacgggcggcgtaatcactcatgccaaccgttttcagcgcctgcgttacacgctcattaattagcgcctttggctgcttctgcgcacgcaggccaaaagcgacgttgtcttccactttcagatgcgggaacaaggcgtagttctgcaccaccatcgccaacccgcgtttatagggtggcagatgggtgacgtccgtatcgccaatcagaatacgaccgcctgcaggttgcacaaagcccgcaaccgcacgcagcaccgtcgtttttccagatcctgatgggccaatcagcgccagcacttcgccaggttcaatcgtcaaagagagcggtttaagcaccacgttgccgtgatacgcaacgcgcagcgagtcgaggactatccccgatgtcccctgcgatgcaggggcgtgaacggtggtcgttttcatcagcatcaggcttactcgctttcggtcactttgtgccaacggctaatatctgccgacagcgaaacggctacgtcatcccaatttggctgccagctctgcacgccttctaacgcggcagtggcggccttataatgttcgtcgctcggcgtcacgtcgctgcgtaccggcattccccaggagagttcgctgacgcgagtctgcgcttctttactcagcaggaagttaatcagctttttaccattttcactctgcggcgccccctggaccaggccaatgacataagggatggccagcgcgctgcgctcgcctttgtcgttggccggccagaagattttcacgttcgggttacgttccatctgcgcgaggttcatttgcaggtcgccgttagcgacgtagatttcacctttattaaccagcgcggttagcttgccggtagaggcagatggcccgacgttattggcctgcagcttgccgagatacgcaaaaccggcatctttactgccgaagctgtggaaagcctgcagcatcaccgccgtgccgtcagcggcctgacctggcgtggaatactggagtttatttttgaatttaccgtcaagcagatcctgccagctcgccggggcagttttcagcagcttgctgttgtagataaagctcagatagttctttaccagcggcgaataaaggttgttggcatcggggatagccgatgcggtgtcggtgttaaagttcgccagcagcttttcggcggcggcgcgctgaatgaatggcggcgcggttaccagcacgtcggcctgtggattcgtgcgctcttttgccagacgttccactaccacgccaccaccgccttcaacatagcgtacggtaatgccggtcgctttggtgaatgcgtcaaactgtacctggtaccagctgttatcgccatcatgcagcccgtcgatggagtacaccgtgaccaccgattccgcccatgacggggcgctggcgagagcgaagacagacagcagagcaagtcgggaaagtttcatcgtaatagcctcatagcgtacgttgcattttctggcctataccaggtttgctttttacgctaaacggcttatatgacaaaacgatgaaagagaaataaatcagtccacgccggatgatgctgcgcttatccggatagccgtgagacgatacgattggtaggccggataagtcccgcagccaacatccggcgcatccgctagtgggtatctacctcaatacgcaggctgtcgtgacgccagtattcgatatccagatccagcactcgcccgtgttgatcgtagttcagacggcgcagcaacagcgccgggcgcccttccataacgcccagcgcctgtgcggcctgcgcaggcatggcggtggggtagaacgacagatgcatgctggtatagacgaggttgtagtgcgactcgtatacctcggtcaggctgccgttgagatcgtactgcagcagctcaggcacgcgggcgggcaaacaatggttttcgcagtagcacacggcgcggccatcggcgtaacgcagacgggtcagcagatagatttgatcaaacggctggagctggaggggctccatgacctcgacaggcacggtggttaacacgccgctcagtagcgcggtttttggctcccgcccctgctcgcggcaaagcttatggaagttggtgttctgggtcggatccagccacaggcgttccggcgtaacgaaccaaccgcgacgatcggcgcgccagataagcccactggactccagctgtgccagactttcgcgaatagtaatgcgcgtggtgttgaagatcgcgcacagttcgcgttcagacggcagtttatcaccgcttttcaacgcaccgctctgaatacgcgcctgaagctgcgccttgatcaacaggtactgcgggatatcgcccgggatagatttcatgcttactcgcttccgttttgcctgccgccattatacaagcagagatgaattttttgttgcagcgcgattttctctttgacccgtcgcggcaaagatcgtcatgataaatgcaatctggtatagaccaaaggtaaataacatgacttcgcgtaactatctgttgctgactcctggcccgctcaccacctctcgcaccgtgaaagaagcgatgttgttcgatagctgtacctgggatgatgattacaatatcggcgtggtagaacagatccgccagcagctgaccgcactggcaacggcctccgaaggctacacctccgtactgctgcaaggcagcggcagctatgctgtggaagccgtactgggcagcgcattggggccgcaggataaggtgctgatcgtcagcaacggtgcatacggcgcacgaatggtcgagatggccggccttatgggaatcgcccatcacgcttacgactgcggcgaagttgcgcgcccggatgtgcaggcgatcgacgcgatcctcaacgccgacccgacgatcagccatatcgccatggtgcatagcgaaacgaccaccgggatgctcaaccccattgatgaggtgggcgctctggcgcatcgctatggcaaaacctacatcgttgacgccatgagcagcttcggcggcatccccatggatattgcagcattacacatcgactatctgatcagctccgccaataaatgcattcagggcgtgccgggttttgcctttgtgattgcccgcgagcaaaaactggccgcgtgcaaagggcattcccgctcgctgtcgttagatctctacgcccagtggcgctgcatggaggataaccacggcaaatggcgttttacttcgcccacacataccgtcctggcgtttgcacaggcgctgaaagagctggcgaaagaaggtggcgtagcggcacgtcatcaacgctatcagcaaaatcagcgcagcctggtggccggaatgcgggcgctgggctttaacacgctgctggatgacgaacttcattcgcccattatcaccgccttttattcaccggaagacccgcagtatcgctttagcgaattttatcgccgcctcaaagagcagggctttgttatctatcctggcaaagtgtcgcaaagcgactgcttccgcatcggcaatattggcgaagtatatgccgccgatatcacggccctgctgaccgccattcgtaccgccatgtactggacgaaataaggaaccatgatgaaccgtattcacgctgttattctcgactgggcgggcaccaccgtcgattttggctccttcgcgccgacgcaaattttcgttgaggcgttccgtcaggcatttgatgtggagatcaccctcgctgaagcacgcgtgccaatggggctgggtaaatggcaacacattgaagcgctgggaaaattacctgctgttgacgcgcgctggcaggcaaagtttggccgctccatgagcgcagcagatattgatgccatctacgccgctttcatgccgttacagattgctaaagttgtcgatttttcttctcctattgccggagttatcgacacgatcgcggcgctacgagccgagggtatcaagataggctcctgctccggttacccacgagcggtgatggagcgcctggtccccgccgccgccgggcatggctatcgtccggatcattgggtggcaacggacgacctggccgcgggtggtcgcccggggccgtggatggcgctgcaaaacgtgattgcgctgggcattgatgcggtcgcgcactgtgtgaaggtagatgatgccgcgccgggcattagcgaggggcttaacgcggggatgtggacggtggggctggcggtatcgggtaacgaattcggcgcaacatgggacgcctatcagacaatgtcgaaagaggacgttgcggtccgccgcgagcacgcggccagcaagctgtacgccgccggggcgcattacgtggtggattcactggcggatttacctggggtgattgcgcatattaatgcgcgtctggcgcagggcgaacgcccgtaaaataactgccggatggcgctgtcgcttattcggcctacagactgtaccgttttgtaggccggataaggtgtttacgccgccatccggcaatcattcttattcgtagtagttataaatccccgccgccatcaccagttgcgaagccacttcatgcgctttttcacgaccagccaacaggtcgatgattttcaaaccaaaatcgatagcggtacccggtccctggctggttaataattttacccgcgcatcccacaccacacgcttatccagccactgttcggcggggatcttatctttcagcgccggaaaaccggtcatattgccgatagggaagatatcgtgcggcacgagcactgtggcggctgcggcgcaaatggctgcgacaatgcgcccggagcggtgaaactgttttacggtttcgaccagcagcgggctgtcgcgaaagcactcggcgcctttaattccgccgggcaacacgatgatgtcataatcgccgtcggcaacttcaaccagcggcgcatccgccagtagctttacaccgcgcgagcagacaatcgtcaggttgccatcgctggcgacgctggcggtagtgacgtggattccgccgcgaaccagcagatcgatagtggtgaccgcttcggtctcttcactaccaggggcgaggcataccagtgcctgagcgctcatactcactctcctttcgctttaccatttcaaacaggcggctattttccggaacggcgagaccgtgcacgcgggcgcgcttgagtaaataaccggtgatgtagtcaatttcggtatggcgcatggcacgcacgtcctgcaacatggatgagatgttttctgccgtactgtcaatcacttgctcaacataatagcgtaaatcgtctgccgatgtgtggtagccttcacgttcaatcacggcggcgacctcttcgcaaatcgcgttgatttcatcagtatgatggcgcagctcgccgttcgggcagttccaaagcgcggtgagcgggttgataacacagttgaccgccagtttgcgccacatctctgcgcggatattgttatgccaggcgacatcgggcagtaccccctgcaggatatcggcgagataactgtaatcgccgtcttgctcgcgcgccgggccaatatgcgtagtaccgttagcgacatgaataatgatattaccgtcgcggcgcgcagcatgggtgatagtccccatcaacatcggctgttggatattttgcagttcttctatggttcccattccattatgaatgagcaggataggcgacgtcaccggtagggttgacgccagggttcgtactgcgtcggaaacctgccacgctttcagcgtgactaataacagttcgctcttcgccaaaaaatccggatcgtttgccgtcagtgattcgttgaaaaaggaaccatcggtatcgatcagatttacgctgcaataaggttgtggcacccgtagccagccctgtacgtcatgtccgtgtttgcacagtgccgaaagccaaagttgtcctaaggctccgcatcccagtacagtaattttcattgttcctcctcacctgcaacagcgccaggtgttatggcgctaattatagcgtcatcagctaagcttctcgttaagcctcgttgcaggtattatgcaacgcaacgaaaatgaagggagaagaaaagatgccatctttcgatattgtttctgaagttgatctgcaggaagcgcgtaacggtgtggataacgcggttcgcgaggttgagtctcgttttgacttccgtggcgtagaggcgactattgaactgaacgatgccaataaaaccatcaaggtgctgagcgagtccgatttccaggtcaatcagttgctcgatattctgcgcgccaagctgcttaaacgcggtattgaaggcgcttcgctggatgtaccggacgagttcgtgcatagcggtaaaacctggtatgtggaagcgaagctgaagcagggcattgaaagcgccgtgcagaagaaaatcgtcaagctgattaaagacagcaaactgaaggtgcaggcgcaaattcagggggaagagattcgcgtgacgggcaaatcacgtgacgatctgcaatcggtaatggcgctggttcgcggcggcgatttgggccagccgttccagttcaaaaacttccgcgattaagttgttatgccggatagagcctcgccgccatccggcaatgcagtattcatcctttgctgataagctgttcaacttcaaagcgattggtcactttgctgtcgattttgacgtaagcggaatgctcttccgccacgatcagcgcttcgcttacgcctttcattgccaacagtcgctgttttagcctgtcgtcagcaacgatatccgctggaatttccacacgcaggctgctgacatagggcggctctttcatggtacttgccactgccagccataccatcgccagtacggccccggcaaggaaaacggtttgcccatcaaacgtgccgtctatccagccgcccagcgagccgccaagcgccacgccaagaaactgactggtagaatagacgcccatcgccgttcctttataccccgcgggcgactctttgctaataagcgaaggcagcagcgcctccatcagattaaaggcgaggaaaaagagttgtacgccaatcaccagctcccagaaatgctggcccgctccccacaacacgatttctgcgacgacaatgagccccacgcagaacaggaatacctgcttcatccgccgtttgacttcagcatagataataaaaggcacgacggcggcaaaggcgatcaccatggttgccagatacaccttccagtgttcggcggcagggaaaccggcatcggcaagctggccgggcagggcgacaaaggtggacatcaataaaatatgcagacacataatgccgaaattgagtttgagcagcctcggctccgccagcactttactgaagctgcctttgaccatcccggattcgcgattcagcacatggttggtactgttgggaaccacccagatcgtcagaagaatgcccagagtggcgagggcggcgatcatccagaacaacgcgttcaatcccagactatgggtaacgatcggccctaataccatcgcaatcgcgaaggtgataccaaagctgacgccgataaacgccatcgctttggtacggttttgctcgcgggtgaggtcagacaggagcgccatgacggcggcggcaatagcgccggacccctgtagcgctcgccccagaataatgccccagattgagtgggagagcgcggcaatgacgctgcccgcgacaaataccgccagtccgccgacaatcagcggtttgcggccaatgcggtcggacagcagcccaaagggaatttgaaagatagcctgcgccagcccgtaaatgccgatcgcaatgccgattaatgcttcgctggcgccctgtagcgccataccgtatgtggtcagtactggtagaaccataaacatgcccagcatacgcaacgaaaagacggtccctaaaccccatgtggcgcgcagctcccctggcgtcattttataatcgttcattgccacctctgtataaaagctgggagtagtgtagtgcggggagtgtgccgggtaaatagagggttaattagcaaatattatgtttttgaaacagttgagctaaaaaagagataaattgttaacacgataggggcgatcgggagagtcagcatagccttgtgctcattcatattccgatctccttgagctgtagtggctatctgagccatctcagtatagtgtagcggttagccacggccttcaggctgtgtgcgctgttgctccatgttgcaatagcagaactcgtcaagccagactgtcagcgaaccgcgctgcctgagtgtggctggccggtgggtgattttaaacttttgctttgccataggaacccgattctgaaacgatggcaatgatcagatccgcccatcttctgaaaatttgatttattcaacaacgccgagactgatagcaaactttctgcgtgatggcgcgcgtttatcaggcagaagattcgtcagcagtcgcatttattatattattcaaggagtgaattcgttatggaaattaaatttttatcattatgtattttagcgggtgttttatttgttagccaggtgaatgcttcagcgaacaacggtaaagatgatgtaaaatatgctgcgcttacccagaaggatcttgatgctttgcctgtggaaaaaagagcttcggttctggatgaactggggtttatccatgaatacggccttagtgtaccgatgaatcgcgaacgggcgttgcagtattacaagcaggcctgtgagcttggcggtaactacggctgttataatgtgaagtatgcttatcagtatggcgacggagtggcgaaagatagcgctcaggccaataagtatgctaagaaaatgaatctggataatttattgattgagcaagaatatattgataagttttcgcaagaaatttacatggcaaaagcattggccgatacggataaatcgcagcgggcggcatttattagtatactaattcatgctctaaataatagacccgagagcgatgcgcttttttttagccgtattggatttaaccaggaaaaaacatttcggctggctacgttatggtcgcaggatggcgacccgcaaatggattatcagatggggcgactcacccttaatgacttttccggtcgctatgcggacgagccttatcaagccagacctgcgtcattgaagtggtttcgcgccgccgcggaaaaaggcgtcgttgaggcccaatctctcttggggggtatttattcggggggagagggcgatgagtgggggattaagccagacattcaggaagcacaaaaatggtatggacaggcggctaagcagggggacagcgatgcacagattgcgttaggtaaaatctattattctggcgcaacagggcgcactgattacgctaaagcgctggcattatttacgcaggttgaaaatgatggtactaattcgcgctcaacgatgccgttgagttggatgtattataacggtttaggtactgcacctgattgtgataaagcctggtcgtattacaagaaagcatctcgatatgtaggtaagaaagttgaggaaaaaatatttttaagtaaatgcgcagcggatattcagagtcgaaaaaacaatgcggatgctttacctaaagtaaccctgaaaaaagagagaattttctctcgcgggataacggctaaaccgaaagaatgcgcactaatttttcagattggcacagataaaatccgtaacatggcgaatttgcatattacgcttgaactgaagaatgctgatggaatggcaactgaggaaacgttgatgattccgccattcggtttgaatactctggggatagatatgcaaaatcatgatgttgatcctctcgttaccccatacgatctcccgctgtatacgcaagatttttgtcacgggatcggcgatatccattttacgctgaaatccgctacggcaacgattaacggtaagaatgtcgatttactgaaagctgacagtgtgcgctttttagataaagaataagggaatgaaaaatgataaaacggaaatggaatcttttgcttctgcttgggctttctttcgcatcggtatgccaggcaggtgatgatattgacgcgttgtatagccgtattgcgcagaaagatattcaggcgctaaatgagctaaaagcgttagccaaagataataacgcccaagcgctggcagaactggggtttatttatgagtacggcgtttcagtatctgtggatattccgcaagcaataaagtactacgagcaggcttgtgatttggacggtgattatggttgctttaatgcggcttatttctatgaatatggcatcggtacccaaaaggacattacgcaagcgaaaacattagcaaaacagcttagagaaaaaattaatctatccaatatcaatctcgataaaaaggtgagtgaacgtataattgggagtgtttatagtaataaacttgaggcatatagagacctttcatttcgtcctcattttattcaaggcttaagtttctatttttatgccccgcaatcagatgagcgaaaactgctgagtcgaataggttttgactcatcacatcttgcgcggatagcgatactctgggcgagagagggtgatcctgaggtcgcgtatcagacggcaaaactggtctctactttgtattttaataatgaaacgaaaacgatagatattgctgaagcgctgaaatggctccgaatttcggccgagaagggggatgccgactcacagacgctgttaggttttctttatgaacacgccggattgggattacaaccagatggagagaaagcccggaaatggtatgaaatggcggcgcagcaaggtaatggagaagcattgtatacgttaggtcgtatgtactattctggcgtactggttaacgttgattacgataaggcgctgtatttttttaaaaaagcttatgagaaaaaattacaggaggccgctgattatttagcacagatgtattttaatggccagagtgtagatgtcgattgccaacaatcctggcactattacgataacagctatataaaaaagatgacacaacgcgattatcttgattattgtgaaaaagatcgaaagcgccgtaatgattttaatcagcaacttcctgagctgacattagaaaaatatgcgggattatttggcaggattgataatattcctctgtgtcagattggatttgttgtcaatacgaataagttaattcatgttgcgaacttacgtgtggaattgatattaaaaaatgatgctggagttagtgacgaaagaatggtcgcttttcctcctttgggtctcaatactctgggtgctgaacagggtatgggggattcttttaagtcgatgggatatctcttgatgaaaaacggtgacttgtgtgattaccataaacttactttcaccgtgaagtcagcgacggcaacaatcaatggtaaaaaagttgatttactgaaaacggataatttacatattattcagaatcgataactcgtggggcgttactgcctgatgaaatggataaaaaaaccgccgtttgtgacacggcggttttttcaatagcaacgcttgttaccagacgtaagtcagcagattctgcgaattcggcaccataaaatcaacggacatcatgatactcagcgcggtaatcgcaatgatagagaagccgaacagcttgcgcgcccagaccttatcatcttccactttgtaaccgcgtagcgccatgccgagccaccaaacgctgaccgccgcggcgaccaccaggtatttgtaaccggcataaccgcccaacgtgagcattagcgttgcaacggcaaacgcaatgatgtacagcgtgatgtggtttttagcgactgagattccttttaccaccggcagaaccgggatattggccgcctgatagtccttaaagcggaaaatggcgatggcgtaagagtgcggcatctgccagaggctgaaaatagccaacaggatcgccgcgccgctgtcaaagtcgcccgttacggcgcagtagccaatcaccggcggcgctgcgccggagagagaaccaatcagcgttccgtagacggagtgacgcttcatgtacaagctgtacacgccaacgtagaccacgaagcccattacccccagccagcaggccagaggattggcgccaaaccacaacagcataaagccagcaatacccagcagggtggcgtataccagcgagacgccaggagaaatcaggcctttgaccagcacccgattcttggtcctttccatcttcctgtcgatatccctgtcgatgtagttgttaaatacacaacccgacgccacaaccagtgacaccccgaccagcgtataaatgaacaggggatagtcaatgctgccctttgaggccagcagaaatcccccgatcaccgagatcaggttgccaaagatgatgcctggtttcgttacttgcaggtattgcttaaacatcatactcgccgctcttagtgcatcatcatgttgtagttgaggttccacataatccagatggagcccacaaccaggatggcgatgatcagcacggtaaagatgaaggccgtcatgttccagccttcatcagatttggtgttcatgtgcaggaaacacaccagatgcaccaaaatctgcaccactgccattgccaggatagatcccagaataacggccggagaggcagcgccggtcatcaccatccagaatggaataaccgtcaggatgaccgacaggataaagccggtcatgtacgtttttacgctgccgtgggatgcgccgccgctctcggtagaatgactcattacatcgcccccatcagataaacaacagtgaatacgcaaatccaaatcacatccaggaagtgccagaacaggctcagacacatgatgcgggtacggttagtgctggtcagaccgcgacgggcaacttgcaccatcagcaccgccatccagatcaaaccggaagtgacgtgcagaccgtgcgtgccgaccagcgcgaagaacgcagacaggaagccgctgcgatccgggcccataccgttaacaatcaggtgatggaattcatagagttccatcccgataaatccggcaccgaacaagaaggtcaacgccagccaggagataacctggctcttgttgttcttgtgcatagcgatcgccgccatgccgtaggtaatggagctaaataacagcaggaaggtttcaaccagaacgaacggcagttcgaaaatgtccttacctgtcgggccgccagcggtgccgttcaccagaacggcataggtagcaaacagaatagagaacagaatgcagtcgctcatcaggtagacccaaaatccgaagattttgttctggcctgcgtcatggtgcccgtgttcgtgcgcgtgggcagtcgcgtgcgttaaagtatcagttgccatttttcagccctgccttagtaatctcatcgaaatgctggttttccagtttttcgacttccgggaccggcacgtagtaatccacatcttcatcaaagctttttacaatccagctgatgatcatgcctgcgaaacccactatcgccagccaccagatatgccagatcatggcgaagccaaataccgtcgcgaaggcggcgataacaataccggcaccgctatttttcggcatatgaatctcttcatactgtccaggctgttggtacgcttcgcctttttctttcatttcccagaaggcgtcacgttcgtgaacgtgcggcacaacggcaaagttatagaacggcggcggagaagaggttgaccactccagcgtacggccaccccatgggtcgccggtcagatcgcggttctgatcgcggtcgcgaatagaaacgaagatctgaatcagttggcacaggatacccagcgcaatcagcgcggcgccggcggcggcaaccatcagcatcgtatggaactgcggatcaatttgctggctgaggcgacgggtcatgcccatgaagcccagtacgtacagcggcataaaggctacaaagaaaccgataatccagaaccagaaggcgcgtttaccccaggtttcgttcagcttgaagccaaacgccttcggccaccagtaggtcatacctgcgaagcagccaaacaccacgccgccgatgatcacgttatggaagtgcgcaatcaggaacagactgttgtgcaggacgaagtccgcgcccggtaccgccagcagaacgccggtcataccgccgaccgagaaggtcacgataaagccaatggtccacatcattgcggaatggaagacgatacggccctgatacatggtgaacaaccagttgaagatcttcaccccggtcgggatggcgataatcatggtggtgataccgaagaaggcgttaacgttcgcgcccgcgcccatcgtgaagaagtggtgcagccaaacgataaacgacagtacggtaatacagacggtcgcccaaaccagcgaggtatagccgaacagacgtttacgcgagaaggtcgctgcgatttcggagaataccccgaagaccggcagaatcagaatgtacacttccggatggccccaggcccaaatcaggttgatgtacatcatcatgttgccgcccatatcgttggtaaagaaatgggtgcccagatagcgatccagggtcagcaacgcgacggtaaccgtcagaatcgggaaagaggcgatgatcagtacgttggcgcacaaagaggcccaggtaaagaccggcatcttgaacattgtcatacccggcgcacgcatcttcaggatcgtcacgaagaagttgataccggttaacgtcgtaccaatacccgagagttgcaacgcccatatccagtaatcgaccccgacgctaggactgtactctattcccgatagcggcggataagccagccaccctgtctgcgcgaattcacccacgcccagcgagaggttaaccagaataacgccgacaacggtgaaccagaagctcaggttgttcaggaaagggaaagcaacgtcgcgcgcgccgatctgcagcggaaccaccaggttcatcagaccgataacgaagggcatcgccacgaagaagatcatgattacgccgtgagcggtaaagatctgatcgtagtggtgcggcggtagaaaacccgcttcgcctgcggaggcaagcgcctgctggctacgcatcatgatggcatcggcgaaaccacgtaacagcatcacaatcgcgacgatgatatacatgatgccgaggcgtttatggtcaaccgacgttaaccactctttccataggtaggtccacttaccgaagtaagtaatcgctgccagtatcgccagtcccccgacgataattgcagcgatcgttaccatgacgataggttcatggaacggtactgcatccagtgataattttccgaacatcttatcttcctcaacccttggagttggcggattccgcgtggctcatgtccataccttccattccttcatgcgagctgtgctcaccttcaggttgggtcatgtccatgctcttaccgtggcccatgaatttgttaataacgtccttgaacaaatcaggtttcacgctggagaaatattccaccttgttgtactcgcttggcatagccactttctcgaacgccgccatatcattcatggtgttcggagactgcttcgcttttgcgacccattggtcgaattctgcgcggtctttggtggcgatagctttaaacttcataccagagaagcccgggccgctatagctggcggagatgccatcgtaggttccgggttcgttggcgatcagatgcaaacgtgtttgcataccggccatggcataaatctggctacccagacgcgggataaagaaggagttcatcacggagttggaggtcactttgaaataaaccggcgtgttcgccgggaaggcgatctcgttgacggtggcgataccctgctccggatagatgaagaaccatttccagtccatggaaaccacttcgatggtgatcggtttttcgtcatgcgccagcggcttgcttggttcaagcgcgtgcgtggttttccaggtcagtacggcaaggaaaatgatgattaagataggcaccgtccagaccacggcttccactttattggagtgtgaccagttcgggctatacttcgcatccttattactcgcacgatacttccaggcgaaaccaacagccatcaagatggcgggaataacgacgatcaacatcaggccaaatgccgtcagtatcagcgaacgttgctccagtccaatctgtcctttgggatccagcagcgcagaattacagccactgagtaatgcagtgcctgcaattaatgacaaccatcccaaacttttattgtatttcctgagtctcatttaacgacctcaattccacgggacctggtggcgtttaaagtgtaggggcattttacggtaaggttacattactgtaaacatgattggttctgtgttaccaagttctgccgcgcatgtcacatatgttgccaagtatgtcgaaataactttaagacactgttgaaactttgcgttataacggatgaggtctgtaagtgggatgttgagggataattggtataaccaatgtaaaaataaaacaattacttaacaatttattatcaataaaaggacaatcaacggcagaaatttaaatttaatcggctgaatcgtgtaaagaaaataggtagcgtagaaattaccaataatttccaaaattctgttgcgcacaaaaagacaaatatattttttatcaattgatggttatttagccgttataattccgggtcgttattacaacggcaaataatgttttacagcaggcgtgtttttcgtagcgccaggtagtccagcaacccgccaaagacaatgccgcacacggcaaccactaccgcagtctcaagcaattcgggcaggaatgagaagttagtgtaatccaccgcgttcatggtcagcaggagtacccataccgccagcaaagcgacgcccgcgagcaggattgaaagcgcgaaattgtaggcgccacggtattgcgtgcggggaatgaaacgctcgctctgccagctatattccagcgtttgccgacagaccagcaacagtaacagcccgggaacggcggcgacaaccgagaagaggtagaatgtcggccagccgtgcgcttcaacgaaccagcccgctacaggaccaacataaacgcggcctactgcggagagggccgacagtagggcaaactgtgttgcggaaaacgacttattacatagcgtcattaataaggcgacaaaggcggcagtacccatcccgccgcacagattttcgaaaaagaccgccgcgcccatgctgaacatgtttttatcggtaatggagagcaaccagtaaccggcgttggacgcgccttgcaaaatgccgaaaatcagcagcgcgcgaaacagcgaaagacgctgcattaatatgccgccgtataacgcgccgacgatcgttgccaacaggcccagcgttttattgaccacgccaacttcaccagcgtcaaagccgacgccgcgaatcaaaaaggtggtggtcaggctcatagcgaaggcgtcccccagtttataaagcacaatgagcagtaaaatcagccaggcgttattacggccaaagaaatcgcgtagcggcgcgacgacggcctgttccagcgatttcggggacgggatagtatcggtcggttccggcgccagtaaggtggcgataatgcaggggatcaacaatgccgccatcagccagtacatgccctgccagccgagccagcgatcggccagccatagcgccagtccgccggaaaccagcatccccaaccggtagccaagcacgctgattgccgcgccagcgccgcgttcttctgcgggtaaaacatcggttttccaggcgtcgaacacgatatcctgcgaggcggagcaaaaagcaatcaccaccgccagcgccgccatccagcgtagctgcgtgccgggttcaagaaagcccatcgccgcaatcgccgccagtaacaacagttgggtggcgagtaaccaaccgcgacgacgacctaaaaaaggcggcgtgtagcggtccatcagcggggaccagagaaacttaaacacataggcctgaccaaccagcgagaagaagccaatcgttttaagatcgatattctcgacggtcatccacgcctgtagcgtaccggaggtgagcgccagcgggagaccggaggcaaaacccaatatcagcagaatggctgagcgcggttgctggaaaatacgtaaatattgacttgacataggcatctacagacccggcttctgccgggtcttgttgttgctattaacgggcgttttgcttgataaaatcgtgaatactggtgtcctgagacatatcagcaatggtatcggtcagaacgctattcactgcgtcggcaatattctggttagaggcctggaacgccccttcaatagagtagttggcgcgatagtttttggtcatcttgctgccatttgccgcggtcgcaataatcgcgatatccgctttggtcgcgatgttgtagcgcacgctgccctgggaaacatcagcatacagttggttaacaattatctgcagattaaccgcgccgttaggcccgatcatatagccccgcgccgtcatctgtttttccaggacttcttgtaacaggaagcgtaaatcgcgggaggcggttaacgttaccagctggttgttacgcgtgactttcgctaacgcttgatcctggcgttggtccgcgccggtaatgctaacggtgacgcccatcaggctcgggtcctgctgtggcaaggtgatcttcggcgcgacgtcaatggtcgtcggcggtgtggcgcatcctgccagcataaacagagcgactaacggaaagagaagtttttttaacatattcaggctctcaatgacgcttaaaacgtgataggtaaaaattcccgccatcataacaccgctaacggcgaggggaagtggtcaacgcaggtaaattcgtcgtaatgtccgatttggtattgataacggcgcgagcggggattttgagcgctaaaagaatgattaaggcagtaaacttcatacgtttggctgaaataatcagacgaaagctaaatttttgttgtcatgctgtaatggaaacggtaaaagcggctagtatttaaagggatgggtgacatcacagcgttgtcggaggagattttcatgatgatacgtgagcaaatagaagaaaaattaaggacagcgttcgaccccgtgtttctcgaagttgtggatgaaagctatcgtcacaatgttccagcaggatcggaaagccattttaaggtcgtgctggtgagcgatcgctttacaggcgaacgttttcttaatcgtcatcggatgatttacggtacgttaacggcggaactttccacaaccgtacatgcgctggcactgcatacttataccctcaaagagtgggaaggattgcaggatactatcttcgcgtcgcctccttgtcgcggcgcgggaagcatcgcgtagcaaaacggatttgcaactacctccgcttttccagtatgttgctacagaattatgtgaaaacggcctgcgggccgttttgttttgtctgaattttgagcgtgtcgtacagtattcagacaaaaattagccgagaattgtgaaaaccgccgcagcatcgcacaatcaccgttctcgactcacaaaagtgatgccgctataatgcgccgtcttatatatgaacgtcttcgggatgattctgacgacagggaatgtgattgattacgagaacatcccggttccgcgaagcaaatagcacgtgcttgcggagtagagttgaccgagcactgtgattttttgaggtaacaagatgcaagtttcagttgaaaccactcagggccttggccgccgtgtaacgattacaatcgctgctgacagcatcgagaccgctgtaaaaagcgagctggtcaacgtagcgaaaaaagtacgtattgacggcttccgtaaaggcaaagtaccgatgaatatcgtcgctcagcgttatggcgcttctgttcgccaggacgtgctgggcgatctgatgagccgcaacttcgttgacgcgatcatcaaagaaaaaattaacccggcaggcgcgccgaactatgttccgggcgaatacaaagtgggtgaagacttcacttactccgtcgagtttgaagtctatccggaagttgagctgaccggcctcgagtccatcgaagttgaaaagccggttgttgaagtcaccgacgctgacgttgatgtgatgctggacaccctgcgtaagcagcaggcgacctggaaagaaaaagacggcgctgctgatgcggaagaccgcgtgaccatcgacttcaccggctctgtagacggcgaagagttcgaaggcggcaaagcgaccgatttcgttctggcgatgggccagggtcgtatgattccgggctttgaagacggcgttaaaggccacaaagctggcgaagagttcactatcgacgtgaccttcccggaagagtaccacgctgaaaacctgaaaggtaaagcggctaagttcgttatcaacctgaagaaagttgaagaacgcgaactgccggaactgaccgaagaattcatcaaacgtttcggcgttgaagatggttccgtagccggtctgcgcgctgaagtacgtaaaaacatggaacgcgagctgaaaggcgcggtgcgtaaccgcgttaagtctcaggcgatcgaaggtctggtaaaagctaacgacatcgacgtaccgtctgcgctgatcgacagcgaaatcgacgttctgcgtcgtcaggctgcgcagcgttttggtggtaacgagaaacaggctctggagctgccgcgcgaactgttcgaagaacaggctaagcgtcgtgtagttgtcggtctgctgctcggcgaagtcattcgtaccaacgagctgaaagcggacgaagaacgcgttaaaggcctgatcgaagagatggcgtctgcttacgaagatccgaaagaagtgattgagttctacagcaaaaataaagagctgatggacaatatgcgtaacgtcgctctggaagaacaggctgttgaagcggttctggcaaaagcgaaagtgtctgaaaaagccacttccttcaatgagctgatgaaccagcaggcgtaatttttcgcgttaaaagcacgaaatttgcacaaaaacccgtcacctttcagtgacgggttttttttgtcacgtattttgcatggtaagggtgcgaaaaccgcgtttcagtgttagcgttagagcaaaagattgttatgcttgaattatggcgatgccgtacccattacagagggactggctgataatccgtccatcaggttacaatcagtacagcagattttttcaatttttatccaggagacggaaatgtcatacagcggagaacgagataatttggcccctcatatggcgctggtgccgatggtcattgaacagacctcacgcggtgagcgctcttttgatatctattctcgtctacttaaggaacgcgtcatatttctgaccggccaggtcgaagaccatatggctaacctgatcgtggcgcagatgctgttcctggaagcggaaaacccggaaaaagatatctatctgtacattaattctcctggcggcgtaattactgcggggatgtccatctatgacaccatgcagtttattaagccagacgtcagcaccatttgtatgggacaggcggcctctatgggggcgtttctgctgactgccggggcgaaaggcaaacgtttctgcttgccgaactctcgcgtcatgatccaccagccgctgggcggctaccagggccaggcgacggatattgaaattcacgcccgcgaaattttgaaagtaaaagggcgcatgaatgaacttatggcgcatcatacgggtcaatctcttgagcagattgaacgtgatactgagcgcgatcgcttcctctccgcgcctgaagcggtagagtacggtttggttgactcaattttgacccatcgtaattgatgccctggacgcaagtgtgccgctatacacttcatccttcacgctacctcggtgttggctgccagcgcgcctcccagtgacttacttatgtaagcgcctgcagagtcgacgagttgccgccttgatgtagctcgaatgattttgtgtatatactaatgaagggcggcacaacgctgattagcggcttgcgcctgagaatggcatttgcgtcgtcgtgtgcggcacaaagaacaaagaagaggttttgactcatgacagataaacgcaaagatggctcgggcaaattgttgtactgctctttttgcggcaaaagccagcatgaagtgcgcaagctgattgccggtccatccgtgtatatctgcgacgaatgcgtcgatttatgtaacgacattattcgcgaagaaattaaagaagttgctccgcaccgtgaacgtagtgcgctgccgacgccgcatgaaattcgtacccacctggacgattacgttatcggccaggagcaggcgaaaaaagtgctggcggtggcggtctataaccactacaagcgtctgcgtaacggcgataccagcaatggcgtcgagttaggtaaaagcaacattctgctgattggaccgaccggttccggtaaaacgctgctggcggaaacgctggcgcgcttgctggatgtgccgttcactatggcggatgcgaccacgctaaccgaagcgggttacgttggtgaagacgtcgagaatatcattcagaaactgttgcagaaatgcgactacgacgtgcaaaaagcgcagcgtgggattgtctacattgatgaaatcgataagatttcgcgtaaatcagacaatccgtccattacccgcgatgtttccggcgaaggcgtacagcaggcgttgctgaaactgatcgaaggcaccgtcgccgcggttccaccgcagggcggtcgcaaacatccgcagcaggagttcttacaggtagatacctctaagattctgtttatctgcggcggcgcgtttgccggtctggataaagtgatcgctaaccgtgttgaaaccggctccggcattggttttggcgcgacggtgaaagcgaagtccgacaaagccagcgaaggcgagctgttgtcgcaggttgaaccggaagatttgatcaaatttggtctgattcctgagtttatcggtcgtctgccagtggtagcgacgctgaatgaactcagcgaagaagcgctgattcaaatcctgaaagagccgaaaaatgcgctgaccaagcagtatcaggcgctgtttaacctggaaggcgtcgatctggaattccgtgacgaagcgctggacgctatcgccaggaaagcaatggcgcgtaaaaccggcgcccgtggcctgcgttctatcgtcgaagcggcgctgctggataccatgtacgatttgccatctatggaagacgtcgaaaaagtggtgatcgacgagtccgttattgccggtcagagtaagccgttgctgatttacggcaaaccggaagcgcaggcttctggcgaataattaaacattcatacaatcagttagccaaaaaaggggggattttatctcccctttcgtttttcctgtaaacacgccgttgaatgtgtgggaaacatccccatatactgacgtacatgttataggtggtatggagcacagctatactatctgattacctggcggacactaaactaagagagagctctatgaatcctgagcgttctgaacgcattgaaatccccgtattgcccttgcgcgatgtggtggtttatccgcacatggtcatacccttatttgtagggcgggaaaaatctatccgttgtctggaagcggctatggaccatgataaaaaaatcatgctggtcgcccagaaggaagcatcgacggatgagccgggtgtaaacgatcttttcaccgtcgggaccgtggcctctattttgcagatgctgaaactgcctgacggcaccgtaaaagtgctggtcgaggggttacagcgcgcgcgtatttccgcgctgtctgacaacggcgaacatttctccgcgaaggcggagtaccttgattcgccagccattgatgagcgtgaacaagaagtgctggtgcgtaccgctatcagccagttcgaaggctacatcaagctgaacaaaaaaattccgccggaagtgctgacgtcactcaatagcattgacgaccctgcacgtctggctgacaccatcgccgcgcatatgccgctgaaactggcggataaacagtccgtactggagatgtccgacgttaacgaacgtctggaatatctgatggcgatgatggaatctgaaatcgatctgctgcaggttgagaaacgcattcgcaaccgcgtgaaaaagcagatggagaaatcccagcgcgagtactatctgaacgagcaaatgaaagcgattcagaaagagcttggcgagatggacgacgcgccggacgaaaacgaagcgctgaagcgtaagatcgacgcggcgaaaatgccgaaagaggcgaaagagaaagcggaagcggaactgcagaagctgaaaatgatgtctccgatgtcggcggaagcgaccgtggtgcgcggctacatcgactggatggtgcaggtgccgtggaatgcgcgtagcaaggtcaaaaaagacctgcgtcaggcgcaggaaatcctcgatactgaccattatggtctggagcgcgtgaaagaccgcatccttgagtatctcgcggttcaaagccgtgtaaataaaatcaaggggccgatcctgtgtctggtggggccgccgggggtaggtaaaacctcgttgggccagtccatcgctaaagcaacagggcgtaaatacatccgtatggcgctgggcggcgtgcgtgatgaagcggaaatccgcggtcatcgccggacttacattggctctatgccgggtaaactgatccaaaaaatggccaaagtgggggttaaaaacccactgttcctgctcgatgagatcgacaaaatgtcttctgacatgcgcggcgatccggcttccgcactgctggaagtgctggatccggagcagaacgtggcgttcagcgatcattacctggaagtggattacgatctcagcgatgtgatgttcgtcgccacttccaactccatgaacattccggcgccgctgctgtatcgtatggaagtgatccgtctgtccggttataccgaagacgagaagctgaatattgctaaacgtcacctgctgccgaagcagatcgagcgtaacgcgctgaagaaaggcgaactgacggtcgacgatagcgcgattatcggtattatccgctattacacgcgtgaagcgggcgtgcgtagtctggagcgtgaaatctccaaactgtgccgcaaagcggttaaacaactgttgctcgataagtcgttaaaacatatcgaaattaacggcgataatctgcacgactacctcggtgtgcagcgctttgattatggccgcgcggatagcgaaaaccgcgtaggtcaggtgacggggctggcgtggacggaagtgggcggcgatctgttgaccatcgaaaccgcctgcgtcccgggcaaaggcaagttgacctacaccggctcgctcggtgaagtgatgcaggaatccattcaggcggcgctgaccgtggtgcgtgcgcgcgcggaaaaactgggtattaatccggacttttacgaaaaacgcgatatccacgttcacgtgccggaaggcgcaacgccgaaagacggtccaagcgccggtatcgcgatgtgtaccgcgctggtttcctgcctgaccggtaatccggtgcgcgcagatgtggcaatgaccggtgagatcacgctgcgtggtcaggtgttgccgatcggcggcctgaaagaaaaactgttggcggcgcatcgcggcgggattaaaacggtcttaattccgttcgaaaataaacgtgacctggaggaaattccggacaacgtgattgccgatctggatattcatcctgtgaagcgcattgaggaagttctgacgcttgctctgcaaaacgaaccgtctggaatgcaggttgtaaccgcaaaatagtgacctcgcgcaaatagcgctaataaaaacagggctggcaggctatttcggacttgccagcctttttttgtatagctaatttagatggttgattgggtctgccaccattaacgggtgttgtaagggcgtggcaggcctgatataactgctgcgcggtcgtacttcgaaggattcaggtgcgatataaattataaagaggaagagaagagtgaataaatctcaactgatcgaaaaaattgctgcaggggctgatatctctaaggctgcggctggacgtgcgttagatgcgattattgcttctgttaccgaatctctgaaagaaggggatgacgttgcactggtaggctttggtacttttgctgttaaagagcgtgctgcccgtactggtcgcaacccgcaaacaggtaaagagatcaccatcgccgctgccaaagtgccgagtttccgtgcaggtaaagcgctgaaagacgcggtaaactaagcgtgatcccctcgggggatgtgacaaagtacaagggcgcatcaactgatgtgccttttttattggcgattcgggactttctgtgcgttgcgggctgacaattgccctcgtttcttgtcacaataggcttttgtgcgccgcgttcagaaaatgcgatgcgcgtgaagtctctatacgcaaatcattcaggttgcgtcgacgcggcgactgagcgaatcactcggtagccagcggagaagccgcctgaaagataaagtgtaaagtcacctacagcggagtgtggttacaccatgatggacagcttacgcacggctgcaaacagtctcgtgctcaagattattttcgttatcattatcgtgtcgttcattttgaccggcgttagtggttacctgattggcggaagcaataactacgccgcaaaagtgaatggccaggaaatcagccgggcacagtttgagaatgcgtttaacaacgaacgtaaccgtatgcagcagcagttgggcgacaggtattctgaactggcggccaacgaaggttatatgaaaagcctgcgccagcaggtgctgaatcgtctgatagatgaagcgctgttggatcaatattcccgcgaactgaaactgggcatcagcgatgagcaggtaaagcaggcgattttcgccactcccgcttttcaggtggacggtaagtttgacaacaaccgctataacgcgattgtgaatcagatgggaatgaccgccgatcagtacgctcaggcgctgcgtaaccagcttaccactcagcaactgatcaacggcgtggccggtactgattttatgctgaaaggggaaaccgacgaactggcggcattagtctctcaacagcgcgtggtgcgtgaagccgttattgatgtcaacgcgctggcggcgaagcagcaggtgaccgatcaggaagtgtccagctactacgatcagaataaagtccgctttatgacgccggaacagttccgcgtaagctatatcaagctggatgccgcgacgatgcaggcaccggtcagcgatgcggatattcaggcctattatgaccagcatgtagatcagtttactcagccggagcgtattcgttacagcattattcagaccaaaacggaagatgatgcgaaagcggtactggatgcgctgaacaagggcgaagatttcgccacgctggcgaaagagaaatctaccgatatcatctctgcgcgtaatggcggcgatatgggctggctggaagagtctgccacggtgccggaactgaaaaacgccggattaaaagaaaaaggccagatatctggcgtgattaagtcgtctgtcggttttctggtggcgcgtctggatgatattcagcctgccaaagtgaaaccgttaagcgaggttcgcgacgacattgccgcgaaagtgaaacaagaaaaagcgctggatgcttactatgcgttgcagcagaaagtgagcgatgcggcaagcaacgacaatgagtcgttagcaggcgctgaacaggtcgctggcgtaaaagccgttgaaaccggctggtttagccgtgacaccttaccggaagagctgaacttcaaaccggtagccgatgctatctttaatggcggtctggtgggcgaaaacggtacgccggggccgaattcagacattatcaccgtggatggtgaccgggcttttgtcgtacgcgtgagcgaacataaacctgaagccgtgaagccgttggcagaagtgaaagaacaggtcactgccctggtgaagcataataaagcggaacaacaggcgaagctggatgcggagaaactgctggtcgagctgaaagcgggcaaaggcgcggaagcgatgaaagcggcggggctgagttttggcgagcctaaaacgttaagtcgtaccagtcaggatccggtgagtcaggcggcctttgcgttaagccttccgacgaaagataagccagtttatggcgtggcgaacgatatgcagggtaacgtcgttctgctggcgtttgacgaggtgaaagcgggcgccatgccggaagcgcagaaaaaagcgatggtgcagggcatcacgcagaacaatgcgcaaattgtctttgaggcgctgatgagcaatctgcgtaaagaggcgaaaatcaaaatcggcgacgctctggaacagcagtaatcgtcgaggcgcttcgcaaaaaattgcaaaacgttgtatcccacaaaggccgctttcgcggccttttccatttctgagaattgccgtttgttcgtttttctccgccccgctatcgtggctgcactgttaacaaacaaggagaaaacagtatgaaacacggaattaaagcactgcttattacgctttctttaacctgcgcgggcatggcccatagcgcgctggcggcgacgcctgtcgcaaaaaatgcagcggtggaaacaaaagcggatacgccttcttcatcctccgccaaagcggcattacctgctaaagccagcgatgatgaaggtaccagggtgagcattaataccgcgtctgcggaggatctggcgcgggtgatgaacggcgttgggctgaaaaaagcgcaggctattgtgagctatcgggaggagtatggtccttttaaaacggtggatgatttaaagcaggtgccgggaatgggaagcgcgctggtggagcgtaatctggcagttttaacattgtaatcacttgcacagtggccaaaatttgccagactgtagaggtcataccagttatgacctctgtacttgtcgtttacttataacaacaacgtaaggttattgcgctatgcaaacacaaatcaaagttcgtggatatcatcttgatgtttatcaacatgttaataatgcccgctatctggagtttctggaagaagcccgttgggatggtctggaaaacagcgacagctttcagtggatgacggcccgcaatattgcctttgtggtggtaaacatcaatataaattaccgtcgcccggcggtattgagcgatctattgaccgtgaccagccaggtacaacagcttaacggtaaaagcggcgtattaagccagacgattacgctggagccagaagggcaggtggtggccgatgcgctcatcacgtttgtttgtattgatttaaaaacgcaaaaagcgctgccgctggaaggcgaattgcgtgaaaagctggaacagatggtgcaataacgcttcgcagtctgatggcgttgaacttgtccggcctggagatattgaccatggtgaatatctccaggccggataaggtgcgtgcgccgccatccggcaaaacaatcaccttaacccggttttttgcttcattgctgccatcaccgccgctttattcgacagataatgattcaggccgttagcgcgcagattacaggctgcgcaatgaccacagccatcgcctttaatgccgttatagcaggtcagcgtctcttcgcgaaccaaatccagttggccccaataatcggccagcgcccaggtttcagctttatcaatccacattaagggcgtttcgaaacggatatctttcgccatgcccagattcaccgcgtgattcagcgctttgacgaactcatcgcgacagtctggatagccggaaaaatcggtctcgcaaacgccagtgatcaccgcttcggctttaacctgataagcgtaaatcgccgccagcgtcagaaagagaatattgcgtcccggtacgaaagtattggggataccgtcagcgttcggttcatagtccggcaccggaatgctatcccgcgtcaggctgctgaccgccagttcgttcagcaaagtgacatccagcactttatgcgcgcgtgcgccaagttttaacgccagcgcccgcgcgacatcaatctctgcgcggtggcgctgaccataatcaaacgtgacacaatgcacttcatcatactgatgccgcgcttgcgccagacaagtggtggagtcctgacctccactaaatacaacaacggcgcgtttcatagttatcctgatcaatgacgaaagccaatatggtaacgcgtacggataatcccgaccagcttcttcacggcgaaggcggcggaagccaggcttcgctaaattcaaaccagccgcgaggggtgagtcgaacgccgttaacgcccggtggggcgctgatgcgatagtgataattaaatagtggcgtaagtgtggcgtcatccatcaggttagcaaaaacttgttgtagcgcggcgcggcgatctttttcattgggctgaatttgcagagcgtcaagcgtagcctgcagatgggaaaacgcaggcgcgtccaggacatgtgaccagatctgatcgcaacgtagccactgctccagcgtatattccggcgcttcgccgatcagcctgtcgcccatcatcagatccgcttgcgccaacgcagggcagttatcccagtttttggcattatgaaaaatcaacgttaactcacagccgagcgtcgccaggtaatgtcgaagctgttccgccatcgtatgcagctctacgggaaggtgatacgccagggtaagttttttcggcaatggcgtttcatcaacgtcctgccattgcgggattgtccagccgggtagcagcccctgacttggcataatcaagttctcatctaccggtaaggttttcagcagcgaagtatgatggataatatgtatcagacgccgcgcctgctgtacgttgagccgtgagccctttttgagggttaaataacaaaagccaagactgataccactacttacctgactcagcgtcgccagctcttccggtttgccgatggcaatctgcaccggatggcggcaactggtgcccagatcctgggcaaacagttgcggggtgatccagaattcaatcgctttcagcagcggatggctgaggtgataatggtcatgactttccagacgcaccagttccggcgtgaacaacgccaggcgaaaaggaccggtgccgataagcggcaggtcaggatgcgccagaccgctacaatagctcgccagacgatgcgccagccagtaatcaggtcggtgaaggagaaaggtcaggcactgaggatgcgttacttcgatccgtgcgacgctaataaacaatttgcttagcgcgggtagggtaagcagcctttccaggcgttcgtgtagctgcgcggtatccaccgcatcgccattatgccagtgcagcgtggagcgaatataaaaatcccagcgtaaaccgtcggcggaaacctcccagtgatgcgccaaatccccgcaaggatattgactgtcgcggtcgaagcgcgttaacccggaaaaaacttgccctgcgagatgctgttccgcgcggcctggcaggaaacccggctgcagcggatcaagcggacgatagtagggaatacgcaatgtcggcgtatcgttttgccattggccgcccataaaaggctggagcatcgcccgtaactcgcccggcgccagctgcgccagttccagtacgttgagctgctgccctttttccagcgcctgttccatcatggcggtgcggagcgattccggcgtgaccagaaactggagccgtccacgtttcccgcgcccggactgcgcctcccatcttagccaacctgcctgctgggcctgacgcagcagcgttcgcagatggcgctcgctacaaaaacagcgttcggccagttcgctaacggtgacatgttgcgtttccccggcggaaggctgccagaggcgttgatattgattaagccgattcagtagcctcatagaaacccggaacacttccttttatctgttcactattacttccgtatatctcaggtaatactgaacaacaagttaaccgcgtcacagtgtggagaaagagatggcccgtctggcagcatttgatatggatggcacgttattaatgcccgatcaccatttgggtagagaaacgatcgccacgctggcgcgtctgcgcgaacgcgatatcaccctgacattcgctacgggtcgtcatgtgctggaaatgcggcatattctggggacgctttcactggatgcttatcttattaccggtaacgggacgcgaattcactcgctggaaggcgacgtgctgcatcgtcaggatctcgatcctcaggttgccgatacggtgatgcaccatgcctgggatacccgagccagtatgcatgtgtttaatgacaacggctggtttacaggccaggagatccccgcgctactccaggcgcacgtctacagcggctttcgttatcaggttatcgatataaaaagcattccggcccatcaggtgacgaagatctgtttttgcggcgatcatgacgatctgatccgtttgcgcattcagctcaatgaggcgctggaagaacgcgcgcacctctgtttctctgccgtcgactgcctggaagtgctaccgctggggtgcaataaaggatcggcgctggcggtattgagcaaccatttagggctttcactggcagattgcatggcgtttggcgacgcgatgaacgatcgggaaatgctgggcagcgtcgggcgggggctcattatgggcaatgccatgccgcagcttatcgccgcgctgccacacctttcggttatcggacattgtggtaatcaagcggtatcacactttttgacgcattggctggacaatccgcatctaccttattcccccgaatgagagatctcttccagcaagccagacattcagtctggcttttttttggtttctagtcgccggtaagtaattttgcgatggccgctgaccacggcgtcaaatcgccgatatggtcgctaacccaggccggatggtaataggtatccagatagcgatcgccgctatcgcacaataacgtcacgatagcgccggtttctccagcctcgcgcatccgggccgcaagctgcagagctccccacatattcgtgccggtagaggcgccgactttacggcctagctgcgtttccagccagtgtgcggtggcaacgctggcggcgtccggcacgcgcagcatctcatccacgacatccggaataaaagaaggctctactcgcggacgaccaattccttcaattttactgcctaccgggctgcgtaatgaagcgtcgcgatcctgccagtaaggtaaaaagacggaattttccggatccaccaccatgagctgagtatcatagccctggcagcgaatatagcgcccaatcgtcgcagaggttccgcccgttccggcgctcatgacgataaatcgcggtaccggatggagttcgttgcgcatctggcggaaaatactgtcggcaatattattgttgccccgccagtcggtagctcgttctgcgtaggtaaactggtccatatagtgaccgttcagttcatgcgccagccgctcggaggcggcataaatttcgcaggcgctctccacaaaatgacagtggccgccgtaaaattgaatctgttcgattttacgttttgcggtacaggcgggcatgacggcgatgaacggcagtcccagtaaacgcgcgaaccaggcttcggaaatcgccgttgagcctgatgacgcttcaataatcggagtgccttctttaatccagccattgcacaacccataaaggaacagcgagcgcgccagacgatgcttgaggctaccggtgggatgcgtgctttcgtctttcaggtaaagctggatacctggaaatgccgacaggggcaaacgaataagatgcgtatccgccgagcgctggtggtcagcgttaatttcattaatggcatttttaacccaattgctactcatcattaatatccatttatcattttgtgccaagagtagcgaaaagtacggaaaaaattgttgctatttgacctttaaattacaatgtaaggagaaaaatattctctatggagtgggtatgttagataaaattgaccgtaagctgctttgcttattgcagcaggattgtaccctctctttgcaggcgctggcggatgccgttaatctgacgacaacgccttgctggaagcggcttaaacgcctggaagatgacggtatcctgcttggcagggtcgcgctgctggacccggaaaaactggggctgggattaaccgctttcgtgttgataaaaacgcagcaccacagcagtgaatggtactgtcggttcgtgaccgtcgtctctgagatgccggaagtgcttggcttctggcggatggcgggggaatacgactatctgatgcgagttcaggtggccgacatgaagcggtatgacgacttctataaacgtctggtcaatagcgtcccaggactgtcagacgtcacctccagttttgcgatggaacagattaagtacaccacctctctgcccattgaataattctcccggtattgccggaaatcatatcaggaaataacgcgtgcgattatttgctcaattaagctggtactttcgccgggaatggcgtcgctatcttggcgcagtggccctgcttatgcttattgcgatgctacagctaatcccgcccaaagtggtggggattgtcgtggatggcgtaaccgcacagcagtttactccaggccgaatagcgatgtggattggcaccattgccctgatcgccgtagtggtctatttgttgcgctatgtctggcgcgtgctgctatttggcgcctcttatcaattagccgttgaactgcgtgaagattattatcgccagttgagtcgtcagcatcctgaattttatcagcgccatcggacgggcgatcttatcgcgcgtgcgacgaatgatgtggatcgcgtcgtatttgcagcgggcgagggcgttctgacgctggttgactcgctggtaatgggctgtgcggtactgattgtcatgtcgacgcaaattagctggcagctaacgctattagcgctgttgccgatgccgattatggcgctgatgatcaaacgttacggcgatcggctgcatgattatttcaaactggcgcaggccgccttctccagcctgaacgaccgcacgcaggagagtctgaccagcatccgcatgatcaaagcgtttggtctggaggaccgccagtcttcgctgtttgcggcggatgccgaagataccggcaagaaaaatatgcgcgtggcgcgtattgacgcgcgttttgatccaaccatttacatcgccattggcatggcgaacctgctcgcgattagcggcggaagctggatggtggttaacggcagcctgacgctgggcgaactcaccagctttatgatgtatctggggttgatgatttggccgatgctggcgctggcctggatgtttaatatcgtggagcggggtagcgccgcatacagccgcatccgcgccatgctggcggaagcgccggtagttaaggatggcgaagagccggtcccggcggggcgcggcgaactgacggcggccattcgtgagttttgctatccgcaaacgacgcatccggcgctggagaatgtgaactttcgtcttaaaccgggtcagatgctggggatatgcggtccgaccggcgcggggaaaagcacaatattgtcgcttatccagcgccattttgatgtgacgcagggagagatccgattccatgacatgccgttgacgcatctgcaactggatagctggcgtagccgactggcggttgtcagccagacgccgtttttgttctcggactctattgcgaataatattgcgctcggacgcccggaggcgactcaggaggagattgaacaggtggcgcgtttagccagcgtacatgaggatattctccgcttgcctcagggctacgacacgcaggtaggtgaacgtggcgtcatgttatcgggagggcaaaaacagcgtatctcgattgccagagcgctactgttaaatgcggaaattctgcttctcgatgatgcgctttctgcagtagatggccgcacggagcatcagattttgcataatttgcgccagtggggcgaagggcgtacggtcatcatcagcgcgcatcgtttatccgcgctgaccgacgccaatgaaattatcgttatgcaacatggtcatgttgttcagcgcggcgatcacgatcaactggcgcagcagattggctggtatcgcgatatgtatcgctatcagcaactggaggccgcgctggatgacgcgccggaacgcggcgaggaggcggtgaatgcgtagttttggacagctatggccgacgctgaaacggttgctggcgtatggctcgccatggcgaaaaccgctctctgtcgcggtgatgatgctgtggattgcggcggcggcggaggttagcggtccgctgctgatcagctatttcattgataacatggtggcccgccaccatttaccgttgggcaaggtcgcggggctggcggccgcctatgtggggctacaatttctggcggcgggtctgcattacgcccagtctttattatttaaccgggcggccgttggcgtggttcagtccttgcgcacggacgtcatggatgccgccttgcgccagccgctaagcgccttcgacacgcagcctgtcggacaattaatttcacgcgtgaccaacgatacggaagtcatccgcgatctgtacgtcacggtcgtcgcaacggtattacgtagcgcggcgttgatcggcgccatgctggtcgctatgttcagccttgactggcggatggcgctggtggcgattttgatttttccggcggtattgaccgtgatgatcatttatcagcgctacagcacgccgattgtacgccgcgtgcgggcatacctggcggatattaacgacggctttaacgaaatcatcaatgggatgagcgtaatccagcagtttcgccagcaggcgcgcttcggcgaacgcatgggcgaggccagccgctcgcactacatggcgcggatgcagacgctgcgcttggatggctttttattgcgtccgctgcttagcctcttttccgcgctcattttatgcggtttgttgatgcttttcagctttacgtctgccggcacgattgaggtcggggtgctgtatgcgttcattagctatttgtcacgtctgaacgagccgctcattgaactgaccacccagcaatccatgctacagcaggcggttgtggcgggagaacgtgtttttgaactgatggatcgcccgcgccagcgctatggcagcgacgacaggccgttacaaagcggggcgattgatattgatcatctgtcgtttgcttaccgcgacgataatcttgttttacaggacattacgctatcagtaccgtcccgtagctttgtggcgctggtggggcacaccggcagcgggaagagcacgctcgccagcttattaatggggtattaccccctgacacaaggcgaaattcggctggatgggcgagaaatcgcctctcttaatcatcgcgttttacgccagggcgtggcgatggttcaacaggacccggtagtgatggcggatacctttctggctaatgtgacgctggggcgcgatgtctccgaggcgcaggtgtggcaggcgctggaaacggtacaactggcagatctggcgcgcggcctgagcgacgggctgcatacgcatctcggcgagcagggaaatacgctgtccgtcgggcaaaaacagctattggcgctggcgcgcgtgctggttgacgccccgcaaatattaattcttgatgaagcgacggccagcatcgattccggcactgagcaggcgatacagcaggcgctggcggcgattcgcgagcgcaccacgctggtggttattgcccatcggctatcgacaatcgtggaggcggataccattctggttctccatcgcggccaggcggtggagcgcgggacgcatcaacaattgctggcggcacaaggacgctactggcaaatgtatcaattacagttagttggcgaggagttagccgccagcgtacacgaagaacccggccctgcggcgtaaggtttggcgccacagggcaaaacctcgcccatcatgcaccgtcgtggtgcgtttttctttccctgtttcgattttggggcgcgtcaatataaagacgcgccgctaaccgcgcttttcctcgctcgccagcttctggcacatcctttgcaatatccattcagaagagtccatgcgcggcggcagccgttacctaattctgactggagggttctatgaagctggttaccgtgattatcaaaccgttcaagctggaggacgtgcgggaggcgctttcttccattggcattcagggactgaccgtcaccgaagtgaaagggtttggccgtcagaaaggacacgccgaactgtatcgcggcgcggagtacagcgtgaatttcctgccgaaggtcaaaattgatgtggctatcgccgacgaccaactggaagaggtgatcgatatcatcagtaaagcggcttacaccggaaaaattggcgacggcaaaattttcgtcgcggagctcatgcgcgttattcggattcgtaccggcgaagctgacgaagcagcgctgtaagacccgccacacagcaacaggaaatgaaaaaatgaagatagcgatgataaaaaccacactggcttcactggcgctgctgcctgggctaacgatagccgcgccggcggttgccgataaagcggatagtgcttttatgatgatttgcaccgcgctggtgctgttcatgacgataccgggtatcgcgctgttttacggcggattaattcgcgccaagaacgtgctgtcaatgttaacgcaagtgaccgtcacctttgcgctggtctgtattttatgggtggtgtacggctattcgctggcttttggcgaagggaatcattttttcggtaatgccgatggggcgatgttgaagaatatcgcgttgacggcggtaacgggtacgatttatcagtatattcatgtcgcgtttcagggatctttcgcctgtattaccgtcgggctgattgtcggcgcgctggcggagcgtattcgtttttcggcggtactgatttttgtcgtggtgtggttcacgctctcttatatcccgattgcgcacatggtgtggggcggcggcctgctggctgctcacggcgcgctggattttgctggtggtacagtggtgcatattaacgccgctatcgctgggctggtgggggcttatttaattggcaaacgcgtcggctttgggaaggaagcatttaaaccccataacctgccgatggtctttaccggtactgcgattctgtatatcggctggtttggatttaacgcgggttctgccggtagcgcaaacgagatagcagcgctggcctttgtgaacaccgtggtggcgaccgccgccgcgattctggggtggattatcggcgagtggacgctacgcggtaagccttccctgctgggagcgtgttccggcgcgattgccggtctggtcggcgtgacgccagcctgtggctatgttggcgttggcggcgcgctggttatcggcgttattgcgggtctggcgggattgtggggagtcaccatgcttaaacgtctgctacgggtagatgatccgtgcgacgtatttggcgttcacggcgtttgcggaatagtcggctgtatcctgaccggcgtttttgccgccagttcgctgggcggcgttggctttgtcgacggcgttacgatgggacatcaggtgatggtacagctggaaagtattgctattacggtcgtctggtccggcgttgtcgcgtttgttggttacaaactggcggatatccttgttggactgcgtgtaccggaagagcaggagcgcgaggggctggatgtgaacagtcacggcgagaatgcgtataacgcgtgattgcgcaacatgcctgatggcgctgcgcttatccagtttaccgtaggccggataagcgcagcgtcatcaggccattaacgccgcatagcggcatgttttttaattgtgattgcgcattaccccttcctgcacggttgaagcgaccagcgcgccatcctgagtataaaactcgccgcgaacaaagccccgggcgctggaggcggaagtgctctccacgctataaagtagccattcattaaaattgaacgggcgatggaaccacatagagtgatcgatagtggcgatctgaatgcccttttccagaaaaccgatgccgtgaggctgaagcgcgacgggaaggaaattcaggtcagaggcatatcccagtaaatattgatggacgcgaatgtcatccggaacggtgccgttggcgcgaatccatacctgacgcacaggcgcggcgacgtgacctttcaacggattgtgaaattcgacgggacgaatttccagcgggcgatcgcagagaaacttttctttcagaatcggcggcagtaaatgcgccagcgattgcgcgatttccgtttctgacggtagtccttccggcccgactaccgtcggcatggttttttgatgttcaaaacccggttccggcgcctggaatgaggcggtcatgtaaaagatgggtttcccgttctgaatagcggcaacgcggcgggcgctgaagctattcccatcgcgcagcacttctacgtcatagataatgggtttttggctgtcgcctggccgcagaaaataactgtggaatgaatgcaccagtcgcgcttccggcaccgtttctttggcggcatagagcgcctggcccaccacctgaccgccaaatacctggcgcagccctaagtcttcactttggccccgaaagagtccttcttcaattttttccagattcaataatgtcagcaaattattcagtgtctgactcatacatactctccaggtgacaacgatgccgaagcgaggtagggcagagtataacgcaattttgcaagtggtccgatgggtacaaaagtctgaataacagaccaattccaggcaaaaatgagtgacatgtgccacacttaatcacgttatgtttctgttaaccactcttccggcggggggaaaggcctgctggtgcattgatgataaggagaattgaatgaaactcgtgcacatcgtaagtggtttagcggttgcgatatctctggcggcctgcgctgataaaagcgctgatatccagacgcctgcgccaaaccctaacatgtcgattacagctaaccagtctactattcagcaacccaatgtttccggtaccgtctggatccgccagaaggtcgctctgccgccagatgcggtgctgaccgtgacgctttcagatgcttcgctggctgatgcgccgtctaaggtgctgtcgcaaaaagcggtacgtaccgaaggtaaacaggcgcctttcagttttgtgttgccgtttaacccatcagatattcaacctaacgcgcgcatcctcctgagcgcggccatcaccgttgataataagctggtatttattaccgatagcgtgaaaccggtgattaataatggcggcactaaagcggatctgacgctggtaccggtacagcaaacggcggtgcctgtgcaggccagcggtggtgcgacgacgacggttccatcgacttcgccgacccaggtcaattcgtcttctgccgttcctgcgcctacccagtattaatcctgcgccaaccctctccgttacggagagggttaatacacccagcgatagcgttgtaaatcgatttgtccgcttcccgacaccaccacgccttccgccagtaatgcctgacgttgccgctgtagatccggcccggtaagtgatattgcgccgtggcggttcaccacccgatgccatggtaaagtgctgccttccggcagacgttttaaaactccgccgacctgacgcgccgcccgaggcgaaccggcaagccgggcgacatcgccgtaggtcgtgacaaacccttccgggatcgaggcgacgatttgccagacgcgttgaggaaatgtgtcctgaatatccataatagaatcctgcgttaatgcttcaggataatctggaataaggggggaggaaagcccggatgcgcaagaaaccagcatccgatgcctgatgggttgcaattgcacgatatagcagtgataatgcgcctgcgcgttggttcacaacgctctcaatgggggctctgttggttctcccgcaacgctactctgtttaccaggtcaggtccggaaggaagcagccaaggcagatgacgcgtgtgccgggatgtagctggcagggcccccacccatttgtgcctctccacactgttcttttctgctgtgcgacgttatagccgctgttccgcccaaagaataaatgccgtagcgggtaggggtttactgtataaccagccctgaccataatgtacgccatgctggcgtagccactgttcttgcctggccgtttcgatgccttctgcgaccatcttaagtttgagcgttttcgccatttcaataatatgcggcgtgacgtttttatattccagcgcatcgacaaaagatttatcaattttaaggacatccacatccagattttgtaagtagctgaggctggaatagccggtgccaaagtcatcaatataaattgaatgtcccgcgttacggtatctggcgacaatgggcgcgctggttttcggatcggcgaactcgcgttccgttaactcaagcgcgatttgcgacggagaaatttggctacggttcagcagcgtgcttaacagcgtcggcaacgtttccgacgccagatcggatgcctcaagattgattgaaatatgttgttcgggatgggactttaaccaactccccatgtcttcaaaaacggtgtcgatgattagccgggttagcggctccgtgagcccggtttgttcagccagcgcgataaaaatttccggcgaaaggaaggtgccgtccgcctgttgccagcgagctaaggcttcggcaccgacaatttttccgctgctcagggagacaataggctgatagtgtacgttaatttcgcgattgtctatcgcatcctggagacggtggcggggcgactgtagtcgacgcaaaatacgcagaataaaggccgcggccagcagacccgttacgatgcccgccggtagccagataaacgcctgtcgataccagctcctttccagcggagcggtcggtgcccagcttacgatagtaatgcccatttccggaaaggggtggatagcatactgaatgcctcggttttccagccgcaggggcgtctcatggtgaatgagcggaagaatagcggggtcaaggttaccgctgctggcaaccacagtattgcgttcccggccaataatagcgacgtcaatcggccatgcgccaaacggaatcacatcgataaaggacgccgggtcgatcatcacgatatagctgtcgctcccgagtgccgccatatagcgttttatacccagatcgttttgcgccgtaaaccaggcgcgataaccgtcgcgagtgattttcatgggcggagggaacgcgggaatatggctctctttttcaagtgaggagcaaacgggaatcgaatttttaagatacagaacttcctggacataccgaaagctataagacacgcggcgcatggcgagtaaatgggcactgctgcagggctcgcctttaaaggaggcaatatgcgttaacgcggcttttgcctggtcactgaccctttctgtacgtagcgccacccgggacgagaagatatccagctcttcattaaacctcttttcaacttgacggtgcgccagccacagactcaatcctatcgggaaaaggacagacaggataagcactcccgttaccaggctgaccagatgtcgtgttgtcacagtgatgtccttataaacacagcgtagagaaagtatatccgatcgtaaatcgcgccctcgaatgataaagctattttatcgattttacagattcaggcgccaggctaacgcgttacgccacgttgcttttgccgccaggaagagatcgtgaatgtttaccggttgaaaaaggagcgttgatagcgtattttattgttatgttataacataattgagagggcgcaatgaaacctgatattcatcctgtataccgcaccgtcgtatttcacgacaccagcgcaaatgaatatgtgaaagtgggatcaactatcaaaactgaacgtgaaatcgaactggacggcgtgacatatccgtatgtcactattgatgtgtcatcaaaatcgcatcctttttataccggtagacagaaaacgtttgatagcgaaagtagcgccgcacgcttccagaaacgtttcggtcattttatcggcgctaaacgggggtaaatgaaatgcaggtgttaaactcacttcgcaatgcaaaacaacggcatccggattgccagatagtcaaacgcaaaggacgcttatacgtgatttgtaaaacaaatccgcgttttaaggcggttcaggggcgtaaaaaaagacgttaaaaaaccaacagttcagggaaagcagtgcgtaccagggagggtgcgcacttttttattaccggctggcttctgcgcgggccagcgtaaaaatatcgtagaaggaaagttcgcccttacgggcaaccattttttgcagctggactttatgttcattatccacctgtggagactgaagaatcgtctcaatgagcgtggggggaacaaagcgggtgttgtaccattcgccgttgtaacagacccggaggtccagcacatcgatgtcgttatagtgataacgcggggcgatgtcgaaaaagaagaagccattaaatgcgataaataacaccactaacagccacactgaccccaccagcgtttctgattgcagcatgaccgccagcgtcgcaaaccaggctgcatacatcgcgataaataacccaggatgcttgcggataaaactgatactaaaacgcggcctgttatcgcgtttttcacggatgtttaagtcatcaatagtttcgctaagcaggcgctgtatctctgtcatcttttgccttcatgatttctgcgacataggggtagtaacagcccattttaaagggaggtgtaacgtgaaaaaagtaacagattaaccacgaattagcataacagttatcattttgactacaattttttaatgattcgcgccggatttccgcctaccacaacgtctggcggtacgttttttatcaccacagcgcctgaagcgacgacgacgttatcgccgatggttacgcccggattaacgacggctcgtccgcctatccagacattatttccgatagtgacgggtttacctaattctctgccgctgttgcgttcgacggcgtccagcggatgcgtggcggtatagatatgtacccctggcgcgagcatacaattatcgccaatatgaattgggcaaacatcaagcatgacgcagtcgaagttagcgtaaaaggagtgaccaagaaaaatattatagccgtagtcgcaacggaaggaaggttcaatataggcgtcttcgcatcgacccaacaggtcgcgtaaaatcgcctgacgcttatttatttcatcaggcgtagtataattgtattgatggatgagttgacgcgcccgcagtcgatcctggcataaagtttcatcggtcgggcaatacagtgccccagcgatcattttttgtttttcgtcactcatcgcgcgctccccttggtggatattatcgcaatagaagcaataataaagtattagagggaacgttccctgctattgctatgtgatctatatcactgttctataatagcccgttgtgttattagccagaacgaggaggcagataacacctgcgtgttctctaaaaagtaatgtagcgtgattaacgaatgaatttccatactgaagaggggatcttgtcgtagagtttgttcatcgtcaattctgcaagacggtgatccgcagctgagtaaaatacagccagctcattgtcggacaattcatatttatttttctcaatgacgcgctccagagtgtcaattgtctgacagcgccgtaaacgcatcaaataatcagttttagttaatggtttatcagacataaattctacctatgattgtaataatttttaacaagacaaactaacaggattggccctggtggcgttgacgaaacaacggaacaggcggttgcccgatttacgccatttttgcaaatcctgcgtattaataccatagctgctgaacaacataaaggtgtcgtccaggtattcatctatctgcgcaatcaatttattgtcttcattgtacttaattttataattaagcgcgaaagttgcaatatgctctatcagctcattgagctgcaggttgactgctgaggtcgggtcattaacccagccatggttgctttcttcaaggtttgcaagacagtcatgatacagggtttcgcaaagaaatttaagctgtgctatatcatgtcttttgggtgagtattcgtccataatgcatcccctttttagtggcttaaactaaccgaacaccttcgggatggatacaactaactaacctggtacttcccacgtcaccttatgatttaactataatctactctaaaaaacttttcatcgtcatattactaaaaattacaattgcgtgaaagccgcgtgttgccatactttttcgaattttaacagtgatcgtcggtcgcctaaaaaggaaccagttttattgtttgtgtaatcattgggttaacgttttttagcttttcaggctaaaacaatagactctgacaggagaaaatagccaggaatattcttaatatttcttaattaatggctgaattaagaaatggccaactttcctaagaaaagcctttaacgcagtaaggattataccttttattaatatggcaaaaaataatcaatctaacaataagcgtattttatgatttttgcgtaaaaaaggccgcttgcgcggccttatcaacagtgagcaaatcagcgatgttctgtcgaatgactatgctcaatatcttcgcttttacggctaaagcggcggcgtaccaccacgaagaagaccggtacgaagaaaatagccagtacggttgccgttaccatcccgcccagtacgccagtacctaccgcattctgcgcgccggaacccgcgccggaactgataaccagcggcataacccccagcatgaacgctaacgaggtcatcagaatcgggcgcaaacgcatccggacggcctccagcgtcgcttctaccagacctttcccttctttatccattaagtctttggcgaattcgacgataagtatcgcgttcttcgccgacaacccaatggttgtgagcaggcccacctggaagtaaacgtcgttagtcagtccgcggaaggtcgcagccagcagcgcgccgataaccccaagcggaacaaccagcattacggagaacgggatagaccagctctcatacaatgccgccagacacaggaagacgacgatcagcgatatagcatacagggcaggggcctggttgccggacaaccgctcctggtaggacatcccggtccagtcatacccaatgcctgacggcagcttgctggccagttcttccatcatcgccatcgcttcaccggtactcttgcctggcgccgcctgccccagaatttccatcgaaggcagaccgttatagcgttccagacgcggcgaaccatattcccagcgggaagaggagaatgcggagaatggcaccatctgaccatcgctaccacgaacgtaccagtcgttaatatcatccggcaacatgcggtatttcgcttcggacatcacgtaaactttcttcacacgaccgcgatcgataaagtcgtttacatagctgccgccccatgctgcgcccagcgtggtattaatgtcgctaatagatacgcccagcgcctgagctttttcctggtcgatatcgattttaaactgcggcgtatcttccagaccgttaggtcgaacgccgaccagcagatcaggatatttcgccacctcgccgaacaactgattacgtgcctgggtgagtttttcatgaccaagtcccgcctggtcaatcaactcgaagtcaaagccggttgcggtgcccagctcaacgatcgccggcaggttaaaggcgaagaccatcgcatctttaatttgtgaaaacgctgcggttgcccgctgggtaatcgcttcaaccttgtttttttcgcctggacgatcggcccagtctttcaacgacacgaatgcaataccggtattctgaccgcgccctgcaaaaccgaagccgttgacggcgaataccgattcaacgttggctttctctttgttcagatagtaatccgtgacctcatccagcactttttgcgtgcgctcttgcgttgcgcccgcggggagctggaccattgtcaggaatacgccctggtcttcatccggcaagaaagagcttggcagacgaacgaacagataagccataccgacgacgataatgagatagagcagcagataacgcccggtgctgcgcagaatattgcctacgctatcggtgtagtgatgcgtgctcttatcaaacaggcggttaaaccagccgaaaaagccttttttcccttcgccatgatcgcctttggcgacgggtttgagcatcgtcgcgcacagcgcaggcgtcaggatcagcgcgaccagcaccgacagcgccatcgccgatacgatggtgatagagaactgacgataaattgccccggttgagccgccaaagaaggccatcggaataaataccgccgacagtaccatcgcgatacccaccaatgcgccctgaatctggcccatggatttgcgcgtcgcttccttcggcggaaggccttcttccgtcataacacgttcgacgttctcgaccaccacgatggcgtcatccaccagcaagccgatggcgagcaccatcccgaacatcgtcagcgtgtttatcgagaaaccgaatgccgcaagcacggcaaaggttcccaacaacaccaccggaaccgcaatagtcggaatcaacgtcgcgcggaagttctgcaggaacaggtacatcaccaggaacacgaggataatcgcttcgaccagcgtttttaccacttcatgaatagagatcttcacgaacggcgtggtgtcatacgggtagacgattttcatccctggcgggaagaacggttccatttttttcagttcggcacgaatagcggtagcggtatccagcgcgttggcgccggtagccagtttgatgccaagacctgacgctggctgaccgttaaatttcgcaatgacgtcgtagttctcgccgccaagctcaattttcgctacatcccgcagacgaacctgggagccatcctgattcactttcagcaggattttgccaaactcatccgttgaggtcagacgcgtttgggcaataatcgatgcgttaagctgctggcctttaaccggcggcgtaccaccgagctgacctgccgcgacctgggcgttctgcgctttgatcgcgttaatcacgtcgaccggcgtcagttggtatttggtcagctctgtcggattcatccagatacgcatcgcatattgcgaaccaaacagctggacgtcgcccaccccagaggtacggctgatcggatctttcatattggcggcaacgtaatccgaaatatcctcctgggtcatggtgccgtcggtgttaatgacgcccactaccatcaggaagctacttgaggacttctcaacgctcacgccctgttgctgtacttcctggggaagtaacggcattgccagttgcaacttgttctgaacctgaacctgcgcgatatccgcatcggtgccggattcaaaggtcagcgtgatctgcacggtccccgtggagtcactgttggaggacatatacatcaggttatcgataccgttcatattctgttcgataacctgcgtgacggtatcctgtaccgttttcgcatcagcgccagggtaggttgcggagatcgtcactgctggtggcgcaatcgtcggatattgcgctaccggcaatttgaggatcgcgagcccccctgccaacatgatgatgatggcgatcacccacgcaaatatagggcgatcgataaagaaattaggcatgtcttaacggctcctgtttaagttaagacctgggctgagcaggttgatcaccgcttgcggcttgctgtttgttatccgcggtaatttcctgtactttaacctgtgcgccaggacgtactttttgcagcccgctgacgactacgcggtcgcccgctttcaatccgtcagtcaccagccacttatcgccgatcgcctggcttgcgacgatttggcgggtttccactttgttatcagcgccaaccaccagcaccgtggcatcgccgcgtggagtacgggtaacgccctgttgtggaaccagtaatgccgtcggttttgtcccttcctgcagacgtgcgcgaacgaacattcctggcaataaggtgtgatccgggttagggaagatggcgcgcaaagtaatagacccggtggtttggtcaacggtcacgtcggagaactcaagcgtaccggactgcgggaatttgataccgtcgctggtcaccaggtcgaccttcgctttgccgttttcctgtttcagcgaaccatttgccagctcctgcttcaggcgcaggaagtcattgctggactgggtcacatcgacataaatagggtccagctgctgcactgtcgccagcgccgacgcctgaccgttctgtaccagtgcgccttccgttacggatgacttaccaatacgaccgctaatcggcgaggtgactttggtatacgccaggttgatacgtgcggtttcaacggcggcttttgctgcgacaacagcggcagtcgcttgttgtgcgtcagccagcgcctgatcgtattcctgcttactgatgtactgcgtacccagcagcttttgataacgcttcaccgtcagttcagcgatattcgcggcggcctgcgcttttgccagatcgcccttagcgctgtcgtaagtcgcctggtaggtcgcaggatcaatctgatagagagagactcccgcttcgatatcacttccctcaacgaaattacgcttcaggataatgccgcttacctgcgggcgaacttcggcgatacggtaagcaacggtacgacccggaagttcagttgtgatttgcagtggttccgtttttagtgtgacaaccccaacttctggcatctgctggccgccttgctggtcctgtttgtcgtcacatcctgttagcgctaagctgcctgagagcatcagaacgaccgccagaggcgttaaccctctgtttttgttcatatgtaaacctcgagtgtccgatttcaaattggtcaatggtcaaaggtccttaaacccattgctgcgtttatattatcgtcgtgctatggtacatacatccataaatgtatgtaaatctaacgcctgtaaattcaccgacatatggcacgaaaaaccaaacaacaagcgctggagacacgacaacacatcctggatgtggccctgcgtttgttctcgcagcaaggcgtatcggcaacctcgctggcggagattgcgaacgctgctggcgtgacgcgcggcgcaatctattggcatttcaaaaataagtcggatttattcagtgagatctgggagctatcagaatccaatattggtgagcttgagattgagtatcaggcaaaattccccgacgatccactatctgtattaagagaaattttagttcatattcttgaagctactgtaacagaagaacgacgccgcttattgatggagattatattccataaatgtgagtttgtcggagaaatggttgtggttcaacaggcgcaacgtagcctttgtctggaaagttacgatcggattgaacaaacgttaaaacattgtattaatgctaaaatgctgcctgaaaatctgctgacccgtcgtgcggcgatactgatgcgcagctttatttcagggctcatggaaaactggttatttgctccgcaatcgtttgatttaaaaaaagaagctcgcgcctacgtcacgatcctgctggagatgtatcaattgtgtccgacgctgcgcgcgtcgacggtcaacggctccccctgataatattccaggaaaactcctggacattttctgtgtcgctattctgtttgttacaggcgtgatattcttgcgactcaattatttccggtctgcttgccggttcagacacttcattctcatgactatgttgcagctttataaacgttcacagcattttgtttttattacaattagcgtccttattatcctgctgtcctgtcagtctctggcatttgcccgggggcaaacgaatggcgacctgccgtcaaaagcggatgtgcaaaaccagctggatacgctgaataagcaaaaagatctctccgcccaggataagctcgtccagcaggaccttattgatacgttagctacgctggagaaaatcgagcgggtgaaagaggagaccgtacagctacggcagaaggtggcgcaggcgcctgaaaaaatgcgtcaggcgacggctgcgttgaatgcgctgagcgacgtcgataatgatgatgaaatgcgaaaaacgctgagtgcgctttcgctacgtcagcttgagctgcgcgtggcgcaggtactggatgatttgcaaaattcgcaaaacgatcttgccgcttataacagccagcttgtttcgctacagacccagcctgagcgcgtgcaaaacgccatgtataccgcctcacagcaaatacagcaaatccgtaaccgtcttgacggcaataacgtcggcgaagctgcgcttcgccccagccaacaggtgttattacaggcacaacaggcgctgcttaatgcgcagatcgaccagcaacgcaagagtcttgaaggaaataccgttttgcaggacaccctgcaaaaacagcgggattacgtgacggccaacagtaatcgccttgaacatcagcttcaacttttacaggaggcggtcaacagtaaacgacttacgctaacggaaaaaacggcccaggaggccatttcgccggacgaaacggcgcgtatccaggcaaacccgctggtaaaacaggaactggatattaaccatcaactcagccagcgtctgattgtcgcgaccgaaaacggcaatatgttgatgcagcaaaacattaaagtaaaaaactggctcgatcgcgcgctgcagtcggaaagaaatatcaaagaacagattgccgtcttaaaaggcagcctgttgctgtcgcgtattctttatcaacagcagcaaactctgccctccgccgacgaactcgaagatatgaccaaccgcattgcggatttgcgtctggagcagtttgaaatcaaccagcagcgtgatgccttattccaaagcgatgcctttgtcgacaagctggaggaggggcataccagcgaggtgaatgatgaagttcatgatgcgttgcttcaggtggtggagatgcgccgtgagctattggatcagctaaataaacagttgggtaaccagctgatgatggcgattaacctgcaagttaaccagcagcagttgatgagcgtctcgaaaaatctgaaagccattttgacgcagcagattttttgggtgaacagtaaccgccctatggactgggactggcttaaagcgttcccccaaacgttaaaagagcaattcagcgccatgaaaatcacggtgaactggcaaaaagcctggcccgcggtatttattgcttttttggccgggttgccgctcttgctcatcgccggtttaatccgctggcgtctgaaatggttaaaagcgtatcaacagaagctggccgccgccgtgggatcgctgcgtaacgatagtcagctcaatacgccaaaagctattctgatcgatctgatccgcgcgctgccggtgtgcctgattatcctcgcgcttggactgatcctgctgaccatgcagctaaatatcagcgatctgctctgggcctttagtaaaaagctcgcgatgttctggctggtctttgggctgtgctggaaggtgctggaaaaagagggcgtggcgatacgccattttggtatgccggcgcagttgaccagccactggcgtcgccagattgtacgcattagcctcgcattgctgccgctgcacttttggtctgtggtggcggagttgtcgccgctgaatctgatggatgacgtgctggggcaggcggttattttcctcaatctgctggtcataacattgctggtgtggccactgtgccgggaaagctggcgcgataaagaatctcacggcattcgactggtgaccgtgacgattctttccattattccagtggcgttaatggtattaacggcgaccggctatttctataccaccctgcgcctggcggggcgctggattgaaaccgtctatctggtcattatctggaacctgctttatcaaacggtgctgcgcgggttaagtgtagcggcgcgccggattgcctggcgacgcgcgctggctcgtcgtcagaacctggtaaaagagggtgcggaaggcgcggagccacaggaagaacccaccatcgcgctggagcagattaaccagcaaacattacgtatcacgatgctgctaatgcttgccctgtttggcgttatgttctgggcgatttggtccgatttgatcaccgtattcagctatcttgatagcattacgctgtggcactacaacggctccgaagctggcgctgcggtggtgaaaagcgtgacgatgggcagcttgctatttgccattattgccgcgatggtggcctgggcgctcatccgcaacttacccggcctgctggaagtgctggtgctttcacgcctgaatatgcgccagggggcttcgtatgcgatcaccacgatccttaactacgtcattatcgctgttggcgcgatgacagtattcggatcgctcggcgtctcgtgggataaactccagtggctggcggcggcgttgtcggtgggtctcggctttgggctacaggagatcttcggtaactttgtctcgggtttaatcatcctcttcgaacgtccggtacgcattggcgatacggtaacgatcggcacctactccggcacggtcagtaagattcgtattcgcgccaccactattaccgattttgatcgtaaagaagtgatcattccgaacaaagcgttcgtaacggagcggctaattaactggtccctctccgataccacgacacgtctggtgatccggcttggcgtggcttatggctcggatctggagaaagtgaaaagagtcttgctacaggcggcgatggagcatccgaaggtgatgcacgatccggaacctgccgtattcttcaccacctttggcgccagcactctggatcatgaactgcgtctgtacgtgcgtgaattgcgcgatcgtagccatacggtggatgaactgaaccgcgcgatcgatcgactgtgccgtgaaaatgatatcaatatcgcctttaaccagcttgaggtgcatctgcataacgcgaagggcgacgaagtcactgaagtgaagcgcgatctcaacggcggcgatctggcacctacggcaagctaaaaggcggtgggccgcgcgctttatgagtgcgcgcggcgccgctaatgcgaaagcgtagaaagctcttccggcgtaatgccggtgacgctggcgatgagcccgggttccagcccgttggcaagcattttgcgggcaatagcgcgcgcttcggcctcacggccttgtgctaacccttgctcaaggcctttttgcaggcccttttgcaacccttccgttcggcctttttcttccagccattccgctattgtcatcagttgttccttatactgcggcgcgccctgcgccagttgacgaattagcgccccgggttctgcggcgtttcctgctttcaacatatagttgatcagcacactgagctgcgcgtccgtcaaatgatcctgcgttaaaagcgtgataagggggtcgagcagttcgcttaaatcgcgttgacgaatatgtttttgcaggagctctaacatcgctatccgccgatgctgcaaaagctgattatccggcattgtcgtcaggtcgaccagcgcaaaatcgcggctgtataaggccttcgccatatccggtttcacaaacatattatgccagttaaggctatagggccacgggctttccggaccgtgataaaaaaggattggtaccaccagcggcaaggtatcatgaccggcatccagatgacgctgcatggcggcaatggcgtaacgcatcaggcgaaaagccatcagccggtctgatttgctctgatgttcaatgagcgcgtaaacatacccggggccgtgttgggtatgcagagagtagagaatatctgaatagcggctgcgtaaattgtcttcaacaaaactccccgactccagcttcagtgaatccagatcgcagattgcaagaaagtcttctggcatgtggatagccagaaagtcgcgggcgacctctttttgcatcagcatctgtcgaaataccgcatcgtgcggcgtggtgggtagacgttccatgccccgtcctttgttgcctgactgtagcgaccactctgtcagcgacaacgaggacaaaccagcgggcaattactctgtttgcgagtcgtcttccgtactttttaacttgttttcataatcacgcataactatttccagcgcgcgtagcaccgttcgtgccggtaagcgattctcttcaagcagcacaattaaatccacggccagtttgacttcatcaggggcattttcaagcgacatactttctccagggttagcgggttaaacgcgccagtacgttttctattttctccagcgcatgtcggcaacgcgccagccgtccttcatagatctcgacttccttttgcagcgtttgttgttcgacaaggccggtcgcctgcgccagacgaattttgcgctcctgtgtcatcgccagtagtcgacgttcaaactcctgatgctgtattcgtctgcgctgccaacggccaagccctggcgcggcggcgtcccactggcgcagcgaccaggcggcggtttcacgcgatatcgcctccagttgcgaagccagatgttccgccagccaggcgacttgcggcagttgctcatgttttaccgcctgacgcaacgcgacgagattggcgcctgcctcttccagatatccctgcaacagagtactgcgggtacggaaaaggtgtcggtcaaagcgcgcgcttaacgtcgcatgttgcgccagcggcgcgcagcgttggcgtagcgtcgccagcctctcttccagcgtctgtaacagcatagcggttttcaattcaacaccccgatgaaaataagacaggctgtgctacagtagccttctgtttgataacgattcgcattatgcaacgtactattttaatcatcattggctggctggcggtagtattagggacattgggcgtggttttgcccctgttgccgactacgccgttcattttactggcggcctggtgtttcgcccgctcgtcgcctcgtttccatgcctggttgttataccgctcatggtttggcggttatctgcgccactggcagcgctatcgggccatgccgccgggagcgaaaccgcgagcgatcgcgttgatattgctgacctttggtatttcgctgtggctggtgaatatgatgtgggtgcgggtgctgctgttggttattttggcctgtctgctgatttttatgtggcggataccggtgattgatgaaaagcaacaaaagcgctgaagcacacgaatcgctgttgcaattgtcgttcacagccagtaaattcgaccgttttcgagcacaggcgcaggcggtcaaagagtaaccgagcgttacccctgaccgaaaagtattgcgccgtgagtaacaccgtacttagcaggcatatatccatgaccgcgactgcacagcagcttgagtttctcaaaaacagcatcaaaagcattcaggattacccgaaaccgggcattcttttccgtgatgtcaccagcttactggaagacccgaaagcctacgcgctcagtattgaattgttggttgagcgttataaaaatgcgggtatcaccaaagtggtcggcaccgaagcgcgtggcttcctgtttggcgcgccggttgcgcttgggctgggcgttggttttgttccggtacgtaaaccgcgcaaattaccgcgtgaaactattgccgagacctatgaattagagtacggcaccgatcagctggaaattcatgtcgacgcgattaaacctggcgacaacgtgctggtcgtggacgatctgctggcgactggcggcaccattgaggcgaccgtgaagctgatccgtcgtctgggcgggaaagtcaccgatgcggcgttcatcatcaatttgttcgatctgggcggcgagcagcgtctggaaaagcaggggattacctgttatagcctggtgccgtttccagggcattgattcaggctattcgcactgctattttagccagagagacaacctcgctgtatcggcgaggttgtgttagcattacccttctatgaatccaccttccagcgtttcagagcctgccaatgagttatcaggtcttagccagaaaatggcgcccacaaacctttgctgacgtcgtcggccaggaacatgtgctgaccgcactggcgaacggcttgtcgttagggcgcattcatcacgcatatcttttttccggcacgcgcggcgtcggtaaaacctctatcgcccggctgctggcgaaggggctgaactgcgaaaccggtattaccgcgacgccgtgcggcgtttgcgataactgtcgggaaattgagcaggggcgttttgtcgatctcattgagattgacgccgcatcgcgtaccaaagtcgaagacacccgcgacctgctggataacgtccagtacgcgcctgcgcgcggtcgctttaaagtctatctgatcgatgaagtccacatgctgtcgcgccacagctttaatgcgctacttaaaacgcttgaagaaccgccagcgcatgtgaaatttttactggcgaccaccgatccgcagaagctgccggtgaccattttgtcgcgctgcctacagtttcatctcaaagcgctggatgttgaacagattcgccatcagcttgagcatattctcaatgaggaacatatcgctcacgaaccccgcgcgttgcagttgttatcgcgtgcggctgacggcagcctgcgcgatgcattaagtctgactgaccaggcgatcgccagcggcgacgggcaggtttcgacgcaggcggtaagcgccatgctcggtacgctggacgacgaccaggctttgtcattagttgaggcggtggttgacgctaacggcgaacgcgtcatgtcgcttatcaacgaggcggcggcgcgcggtattgaatgggaagcgctgctggtcgaaatgcttagcctgctgcaccgtattgcgatggtgcaactttcgcctgccgcgttaggcagcgatatggcggctatcgagcaacggatgcgcgaacttgcccggacggtgcctcccggcgatcttcagctctattatcagacgttgttgattggtcgcaaagaattgccctgggcgccggaccggcggatgggcgttgaaatgacgttactgcgtgcactggcgtttcacccgcgtatgcccttgccggagcctgaaacgccgcggcagtcttttgcgcccgtggccccaacggcggtaatgacgccgccgcagctgcagcagccgtcggcgcccgcgccgcagacatcgccagcgccgctgccggcgtctaccagtcaggtgctggcggcgcgcaatcagctacagcgcgcgcagggagtaaccaaaacaaaaaagagtgaaccggcagccgcatcccgcgcgcggccggtgaataactctgcgctggagcggctggcctcggtttcggagcgcgtacaggcgcgcccggcgccgtccgcgctggaaacggcgccagtaaagaaagaggcttatcgctggaaggccaccacgccggtagtacaaaccaaagaagtggtggctacgccaaaagcgcttaagaaagctctggagcatgaaaaaacgccggagctggcggctaaactggcggcggaagcgattgagcgcgatccgtgggcggcgcaggtaagccagctttctttgcctaagctggtggagcaggtggcgcttaatgcctggaaggagcagaacggcaacgcggtttgtctgcatctgcgttcgacgcagcggcacctcaattccagcggcgcgcagcaaaagctggcgcaagcgctcagcgatctgacgggaacgacggttgaactgaccatcgttgaagatgataatcccgcggtgcgtacgccgctggaatggcgtcaggccatttatgaagagaaactcgcgcaagcgcgtgagtcaattattgcggataataacattcagacgctgcgtcgattcttcgacgccgagctggatgaagagagtatccgccccatttgatcgtaagcccggcttgcgattgtgaaccatcaagagagagagcttatgtttggaaaaggcggtctgggcaatctgatgaaacaggcccagcagatgcaggaaaaaatgcagaaaatgcaggaagagattgcgcagctggaagtgaccggcgaatccggcgcgggtctggtgaaggttaccatcaacggcgcgcataactgccgccgcgtggaaattgacccaagcctgctggaagatgacaaagagatgctggaagatctggtcgctgcggccttcaacgatgcggcgcgccgcattgaagagacgcaaaaagagaagatggcttccgtctcttccggtatgcaactgccgccaggctttaagatgccattctgatgcaaaccagtccgctgttaactcagcttatggaagcgttgcgctgccttccgggcgttggccctaagtcggcgcagcggatggcgtttaccctgttgcagcgcgatcgcagcggcggaatgcgcctggcgcaggcgctgactcgggcgatgtcggaaatcggccactgcgccgactgccgcacctttaccgagcaggatgtttgtaatatctgctcgaacccgcggcgtcaggaaaacggccagatttgcgtggtggagagtcctgcggatatctacgccattgagcagaccgggcaattttccgggcggtatttcgtgctgatgggccacctgtcgccgctggacggcatcgggccggatgatatcggtcttgatcgtctggaacagcggctggcgtcagaaaaaatcagtgagctgatcctcgcgaccaacccgacggttgaaggggaggctaccgcgaactatattgccgagctgtgcgcggaggccggcgtcgaagccagtcgtatcgcccacggcgtgccggttggcggcgaactggagatggtcgacggtacgacgctgtcccactcgctggcgggacgccataagattattttctgaacaaacggaggcggcattcgcggcctccgcttgaaatcacacccgcttgtccccatctcaccctcaacgtatttttaccattaaaaatggcattgttgaggtctatccacatgaaaggacaagaaacgcgtggttttcagtcagaagttaaacagcttctgcacctgatgatccattctctttattccaataaagaaatcttcctgcgtgaactcatctctaacgcctcagatgcggcggacaagctgcgtttccgcgctctgtcaaacccggatctgtatgaaggagatggcgagctgcgtgtgcgcgtctctttcgataaagataagcgtacgttgaccattgccgataacggcgtggggatgaatcgtgatgaggtgattgaccacttaggcaccattgccaagtccggcaccaaatctttcctcgaatcaatggggtccgatcaggcgaaagatagccagctcatcggtcagtttggcgtaggcttctactccgcgtttattgtggccgataaagtgaccgtacgtactcgtgcggcaggcgacaagccggaaaatggcgtgttctgggaatcggcaggcgaaggcgaatacaccgttgccgatatcaccaaaaatgaccgtggtacggaaatcaccttacacctgcgtgaaggcgaagatgaattcctcgatgactggcgcgtacgctcgattatcagcaaatattccgatcacatcgcattgccggtagagattgaaaaacgggaagaaaaagacggcgaaaccgtgatttcctgggagaaaatcaacaaggcccaggcgttgtggacccgtaacaagtcggaaattaaagacgacgagtacaacgagttttacaagcacatcgcgcatgatttcaccgatccgctgacctggagccacaaccgcgtggaaggtaagcaggagtacaccagcctgctgtatatcccgtcgcaggcgccgtgggatctgtggaaccgcgatcacaaacatggtctgaagctgtacgtacagcgcgtgttcattatggacgatgccgagcagttcatgccgaactatctgcgtttcgtgcgcggcctgattgattctaatgacctgccgttgaacgtctcccgtgaaatcctgcaggacagcacggtaacgcgtaatctgcgtagcgctctgaccaaacgcgtcctgcaaatgctggaaaaactggcgaaagacgacgcggaaaaataccaaaccttctggaaacagttcggtctggtgctgaaagaaggcccggcggaagatcacgccaaccaggaagcgatcgctaaactgttgcgctttgcctccacccataccgactcttccgcccagaccgtgtcgctggaagattacgtctcccggatgaaagaagggcaggaaaaaatctactacatcaccgcagacagctatgcggcggcgaaaaacagcccgcacctggaactgctgcgtaagaaaggcatcgaagtgctgctgctctccgatcgcatcgacgagtggatgatgaactacctgaccgagtttgacggtaaagcattccagtcggtcgctaaagccgatgaatccatcgaaaaactggcggatgaagtcgacgaaaacgcgaaagaagcggaaaaggcgcttgagccgtttgtggagcgtgtcaaaaccctgctgggcgatcgcgtgaaagacgtgcgtctgacgcaccgtttaaccgacacgccggcgattgtcaccaccgatgcggatgaaatgagcacccagatggcgaaactgttcgccgcggctggtcagtccgtgccggaagtgaaatacatctttgagctcaacccggatcatgtgctggttaaacgcactgccgataccaaggatgaagcgcagtttaaagagtgggttgagctgctgctggatcaggcgctgttcgctgaacgcggtacgctggaagatccgaaccagtttatccgccgtatgaaccagttgctggtgtcctgataacgctcatctgactgccggatggcgacgcgaagcgtcttatccggcctacggcgagtactgtttgtaggccggataagcgccagcgccatccggcattttttataataccttctcttttctggatttctcttcgttaaccgtttcagcatcaggcggcttccttgagcgaaatgcgtgatggtggtatcgtttagcgctttttaaaaaatatcgacaacctttgaggggattttcgtaatgcgtattattctgcttggcgctccgggcgcgggtaaaggaactcaggctcagttcatcatggagaaatatggtattccgcaaatctccactggcgatatgctgcgcgccgcagtgaaatcaggctccgagttgggcaaacaggcgaaagatatcatggacgccggtaaactggtgaccgatgaactggtgattgcgctggttaaagagcgtatcgcccaggaagactgccgtaacggttttctgctggacggtttcccgcgcacgatcccgcaggctgacgcgatgaaagaagcgggtattgtcgtggattacgtgctggaattcgacgtaccggacgaactgatcgttgaccgtattgtgggtcgtcgcgtacacgccgcctctggccgcgtttaccacgttaagtttaatccgccgaaagtggaaggcaaagatgacgtcaccggcgaagatctgaccacccgtaaagacgatcaggaagagaccgttcgcaaacgtctggtggaatatcatcagatgaccgcgccgctgattggctactaccagaaagaagcggaagcgggcaacaccaaatacgctaaagttgacggtacgcaggccgttgccgacgtgcgcgcagcgctggaaaaaatcctcggttaattttttcgcgtagtgaagcacttatcaggcctgctgttatcccgcaagcctgataagcgtaacgccatcaggcaatcggtgccggatggcggcctgaacgccttatccggcctactggcatcgttagcgccattcggcaaattctcgtcttacctctcgcagcaattagttcttctttatcgcttttccgctacaattatcaacaatttgaatagataagaggcggcaatgcgtcagacgaaaaccggtatcctgctggctaaccttggcacgccagatgccccaactcctgaagcggtaaagcgttacctgaaacaatttttaagcgacagacgcgtggtggatactcctcgtctgctgtggtggccgctgctgcgtggcgttattttaccgctgcgttcgccgcgcgtcgcgaaactctatcaatctatctggatggatggcggttcgccgctcatggtatatagccgcgaacagcaacaggcgctggccgcgcggttgccagatacgcccgtcgcgctggggatgagctacggctcgccctcgctggaaagcgctgtcgatgaactgttagcaagcgacgtcgaccatatcgtcgtgctgccgttgtacccgcaatactcttgctcaacggtgggcgcagtctgggacgaactggggcggatactggcgcgtaaacgtcgtattcccggtatctcatttattcgcgattacgcggatgacggcgcttatatcgatgcgctggcgaaaagcgcgcgtgagtcgttcgccaggcacggcgagcccgatgtgcttctgctctcctatcacggcattccacaacgttatgcggatgaaggcgatgactatccgcagcgctgccgcgataccacgcgcgaactggtttccgcattgggactgccgccggaaaaggtaatgatgacgttccagtcgcgctttggccgtgaaccgtggctgacgccgtacaccgatgaaacgctaaaaatgttgggtgaaaaggggactggccatattcaggttatgtgtccgggatttgccgcggattgtctggagacgctggaagagatagcggaacagaaccgcgagattttccttgaagcgggcggtaaaaaatatgcgtacattccggcgctgaacgcgacgccggaacatattgatatgatgctgaaactcacggcgccgtaccgttaacgcggcgtcttcatcctcgccataaagaagcgtgcgccgtcctgcaaggcatcgtcggcgattgtcatcattcgcgaatagtgcagaaaggcgtgcagcgtgccgggatacattttgtattcgcagggctgctggtgcgcctgtaatgtctggtgcagcaagcggctgtcatcaatgagcggatcaaactccgcgctggcaataaagcagggcggcacatcgcgcgtgagatcgttattaaacagacaataccagggcgattcccgatcttcatcgttacgcagataggccttttcgtacatgtccagatcttcacgcgtcaggccgtcccacgcgccgccgaacagacggcggcttaccgaatcttgcaacccatacagcccataccacaacagaatcgcgataacgttaccgcagcgaatgtgcttatcacgtagccagagcgcgctggcaagcgccagcatggcgcctgcggaatctccggcgaaaccgattttctccacgttgagcgagtattcatcggcatgttgagagaagtagctgcataccgcgacggtttcttcaatggcctgtggataacgcgcttgcggcgacagcgaataatcaatgccgatcacggtgcagccggtataacgcgccagcagacgcattatccggtcatgcgtatccaggttaccgaggataaatccgccgccgtgcagatagtataaggtggcctggctggtcggctgcggcgagtagagccgggttgttacatcgccataaggcgtagggacggcgcaggtgcgggtggtcatggacggcgcgtcggcattccagaaacggcgctcaagaagataatactgacgctgggtctcaatatcgccatcggcaggccaggggggaaggcctggttgctggaagtttacgacggctgtcatttcgtctgacagtcgggtgagtacgggaattttattttccggcttcataaaacgctccttgtgaaagtgaaccattgtaaaaaacgcggctggagaaactgcgatctcgtcgtccgatattgaaacgccatcgtccgtcgcgcgcagcagggggaatgtgctaccatgcagcgctccgttattcatccgtaagcacaatcatgaaatttcccggtaaacgtaaatccaaacactattttcccgtcaatgcgcgtgacccgttgttgcaacaaattcagccagaacaggaaaccaacgcctcctgggtcgtcggtatcgaccagacgttggtggatattgaggcgaaagtggatgacgattttattacacgctatggattaagcgccgggcattctctggtgatagaagacgaggtggcggagaagctgtatcaggaactgacgcgggaaaatctgatcacccatcagtttgctggcggcaccataggcaatacgatgcacaattactcggtactggcggatgaccgttcggtgttactgggcgtgatgtgcagcaacattgagattggcagctacgcttatcgctacctgtgtaatacttccagccgtaccgacctgaattatctgcaagcggtagatggcccgattggccgctgtttcacgctgattggcgaatccggcgagcgtaccttcgctatcagccccggccatatgaatcagttacgggcggaaagtattccggaagcggtgatcgctggcgcttccgcgctggtgttgacctcatatctggtgcgctgtaagcctggcgaaccgatgcctgacgcgacgatgaaagcgatcgaatacgcgaaaaagcataacgtgccggttgtcatgacgctgggcaccaaatttgtgatcgccgataatccgcagtggtggcaggcgtttctcaaagagaatgtctcgattctggcaatgaatgaagaagaagcggaagcgctgaccggcgaaaacgacccgctgctggcggcggataaggcgctggactgggtcgacctggtgttatgcaccgccgggccgatagggttatatatggcgggcttcaccgaagaggaagcaaaacgtaaaacccagcatccgctgctaccgggagctattgctgaatttaaccagtatgaatttagccgggcaatgcgccataaagattgtattaatccgctgcgcgtttattcgcatattgcgccgtatatgggcgggccggaaaaaatcatgaacaccaacggcgcgggcgatggcgcgctggcggcgctgctgcacgatattacggcgaacagttaccatcgtagcaacgtaccgaactccagtaagcacaaatttacctggctgacctattcgtcgctggcgcaggtgtgtaaatatgctaaccgtgtcagttatcaggtactgaaccagcattctccgcgtctgacacgcgggctgccggaacgtgaggacagcctggaagagtcgtactgggatcgctaatctggcttgcccgatggcgctgcgcgcatcgggccgtccggcaaacccttaactggcgacgacttcacccgcgggcggcgtttcaagcagttccagcatcgcccgggcaatttctcgctcgcccatcactacctgattggctccccgctcggtaatatatttcacttcatcatcatagtgcgcgcgggcgattatctcgatatcaggactttttccccgcgctgaggcgacaatctcaccggcttcgtaaccgttggggatggtcaataacagccagcgagcgcagtccagatgcgccagattcatgatttcttcgttagcggcgttgcccagtacggcgcgaatcccgcgttcgcgcagttcatccacgcgggtacgggacgtttcgataaccaccagcggaatccccgccgccagtaatttttctcccagcagactgcctacgcggccaaaacccaccagcagggcatgattacagatatccaccggaatttgcttctcttcttcgatagcctcttccagagtttgctcttccagcgtttcggttttcgccagatacttctccagcagggtaaacagtacgggattaagcataatcgacaaaatagcgcctgccagcaccaggttctgtcccgcttgcggcagcaggttgagcgccatgccgagcccggcgagaataaaggcgaactcgccgatttgcgccaggctggcggcaatggtcagcgcggttcgcggcgagtggccgaacaaacgcaccaggaaaaacgcagcgatcgatttgccaaagacgataatggcaagcgtcgccaacaccgccagcggctgttgaatcaagactaacggatcgaacaacatgccgacggaaacaaaaaacaggacggcaaaggcgtcgcgcagcggcaacgtatcgtgcgccgcccggtgactcagttccgactcattaagcaccattccagcgaagaacgcgcccagcgcaaaagagacgtcaaacagttctaccgcgccaaacgcaatgcctaacgccagcgccagtacggaaagggtaaataattcgcgcgagccggtggcggcgctgcgggccataatccacggcaccaggcggcgtccgaccagcatcatgatggcgataaacgccaccactttaccaatggttatccccatatcgactgtcagcgaggctatgccgacatcgcctttttccaccatgccggcaacggcgggcagcaagaccagcgtcagcaccatcaccagatcttcgacaatcagccagccgatggcgatttgcccgcgctggctatcaaggagttgtcgctcctcaagcgcgcgcagcaggacgacggtactggctgtagacagacagagcccaaaaacgatgccggtcattaatgaccatcccagcacggcggaaagcgccatacccagcagcgtcgccaccgctatctgagcgacagcgccgggaatggcgatagactttaccgccatcaaatccttcagcgaaaaatgcagcccgacgccgaacatcaatagaatcacgccgagctccgccagctccggcgccagtttggtatccgcaacaaaacccggggtaaaaggtcccgccagaacgcccgctaacagatatcccaccagtggagaaatacgcaatttgttggcaatcatgccgagaataaaagcgagcacaaggccgccgacaatggtggtgataagcggggtagcgtgatgcattccgtctcctttggttgctggactccaaaactccgggtaatagtttatgacaatttcaatcaggatgtttataaaaaatggttgtgttttataaaaagatacgatctgaaggcaaaaagagcacggaacgtaaaagtgataagtatgggatggacaaagcaagatggcatcaggatgtacaggcggttaaagcgtacctttaaccgccataaaatcatgctttatgtcgattatcaggtaagaatatggtcagtatccccagaagcggcaggaaagcacagattttataaactaaatagatactggtatggtcggcaatcagccccagcaccgctgcgcccaggcctcccatcccgaaggcaaacccgaaaaacaggccggaaaccataccgatgcgtcctggcagcagctcctgggcatacaccagaatggcggaaaacgccgacgcgagaataaagccgataatcaccgttaaaatccccgtccagtacagcgtggcgtagggtaaaacaagggtaaacggcgcgacgccgagaatagagccccaaatcacatatttcctgccgattttatcgcccaccggcccgccgattaccgtcccggcagccaccgcaaacaggaaggcaaacagatggagctgcgcgttttgtattgataatccgaatttttgcatcagataaaaggtgtagtagctactgatgctcgccatataaaaatatttcgagaaaatgagtagcaataacacgctgaccgccagcacgactttattgcgcggcagcgggttagcgattatcgcttttggcttgcctttcgctatccggtgctgggctgcataccagcggctgatctgcgccagcaccacgatcgccagcagcgcggccagcacaaaccaggcgacattccctttgccatagggcgcgataatcacggcggccagcagcgggcccaatgaactgccgaagttaccgccgacctggaagatagactgcgccagaccatgacgtccgccggaggccatgcgcgccacgcgggacgattccgggtgaaaaacggacgagccggtacccaccagcgccgcagcgagcaatacgccgccaaaacttcccgccattgccagcagtaccagcccgctcagggtaaaacacatgccgacaggcagcgaccacggcatgggatacttatccgtccagtagccgacgaccggttgcagcagcgatgaggcgagctggaacgtcagggtgatcaaacctatctggacgaaggtcagcgagaactccgcctgcaacaggggataaatggctaagattagcgactggatcatatcgttcagcagatgggaaagactgatcgcgcccaaaataccaaacgaagtacgtgctttagcggccgctgcgggcgcgccggctaacggctgggttggttcactcatggccatagaaagtcacttaaattttatgcgatgttggagatagtaggatgtgtaattattacttgcctaacatacctgtgaaatgtgtttgaaggaagtctcaattctgaaaacatatttgtctattattgcaaggaaaggtaatttctgcggttgatattgagtcagggagagaaagatgaaatttttgaaacggggtgtggcgctggcgttactggcggcgttcgcgctgacgactcagcctgcacaggcttacgaaaaagataaaacctataaaattactatcctgcataccaacgatcaccacggtcacttctggcgcagcgaatatggcgaatatggtctggcggcgcaaaaaacgctggtggacagtatccgtaaagaggtggcgcaagaggggggaagcgtcctgttgttatccggcggcgacattaataccggggtgccggaatccgatctccaggatgcggagcccgatttccgcgggatgaatctgattggctacgacgctatggccgtcggtaatcatgaatttgataatccgctcaccgtattgcgccagcaggaaaagtgggcgaagtttccctttctttacgccaatatttatcaaaaaagtaccggcgagcgtctgtttaagccgtgggctatttttacacgccaggatataaaaatcgcggtaatcggcttaaccaccgatgacacggcgaaaataggcaacccggaatatttcaccgatattgagtttcgtaaacctgctgaagaagcaaaggtggtgattcaggaacttaatatgaatgaaaaaccggacgtgattatcgcgaccacgcatatgggacattatgacaacggcgatcacggttcgaacgcgccgggcgacgttgagatggcgcgtagcctgcctgccggttcgttggcgatgattgtgggcggtcactcacaagacccggtatgcatggcgtcggaaaataaaaaacaggtgaattacgtaccgggaacgccctgcgcgccggataagcaaaatggcatctggatcgtgcaggcgcatgagtggggtaaatatgtgggccgtgcggatttcgaattccgtaacggcgagatgaaaatggttaactaccagcttattccggtaaatctcaagaaaaaagtgacctgggataacgggaaaagcgagcgtgtactttacacgccggaaatcgcagaaaatccgcaaatgctctcgttattaacgccgttccagaataaaggtaaagcgcaactggaggtgaaaattggtagcgtgaatggccttcttgaaggcgatcgcagtaaggtcagatttgtccagaccaatatgggacgggtgattctggctgcgcagatcgcgcgcaccggcgccgattttggcgtgatgagcggcggcggtattcgcgactcgattgaggcgggagatattacctataaaagcgtgctcaaggtacagccgttcggcaacattgtggtgtatgccgatatgagcggcaaagaggtggttgattatctcaccgccgtagcacagatgaaaccggactccggcgcctatccacagctcgccaatgtgagctttgtcgccaaagagggcaagctcaccgatctgaaaatcaaaggcgagcctgttgatccggctaaaacctatcgcatggcgacgctgagtttcaacgccacgggcggcgatggttatccgcgcattgataacaaaccgggctacgtgaataccgggtttattgacgcggaagtgctgaaagagtttattcagcaaaattcaccgctggatgcggcggcgtttacgccaaatggtgaggtgagctggctgtagcggtacggatagccatttctgcctgatggcgcgcaaccttaaggcctacggattatgtctgctgtaggccggataaggcgtttgcgccgctatccggcaatgtattttacgcaggcttaatcccgacgcgcgatatcagcgaatttagcacccaggatggcggccaaatcgtcagccgccagttcaatatccagcccgcgtttaccaccggaaacataaatagtggcaaacgtgcgggctggcgcgtcaatcagcgtgggcagccgtttcttctgtcccagcggactgatcccgccgaccagatatcccgtggtgcgttgcgccaccatcgggtcggccatatcgacctttttcgcgcccagagctttggcgacttttttcaaatccagctgtccggctacaggcgtcacggcgacggccagttgcttcatatcgccattcacggcgaccaaaagcgttttatacacctgatcggcgtttagcccgagcttacgcaccacttcatcgccaaagttagtttcattcggatcgtgatcgtaggtgtgaatgttaaacggaatcttgtttttttcgagtaacttaactgcgggtgtcataacgttccttcttactacagacgtgatttgccatcagcatacgcccgaaagcggactaaaaaatagtataatcttgtgcattaggtcttggcagttgcggcaactttgagcgacaatctgaagatccgaagcgaaagcgtcgggataataataacgatgaaattcctctttgacgggccaatagcgatattggccatttttttatttcaatatttgcggtaggttgccttcgccgtacagatgtagcgcccctacggctaccacgtagcgtcccggcggcagtgccagcagcgcgtcgcgccaggcttcattgcgtttcaccatcagtacatcatacagcggctggctaaacgttctggggagcgaagcgccgacgctggtcggcggctgctcaagccaccagccgatcatcacctgcaaaagccgtgcgttggtgtgccagtgcgtcagcgtgtcgtcgagcagcgccatcccgccatcgggcagatcgcagagtagttcgagctggtgtttcgccccttccagctcttgcaccggcagcgacatttcgcgggcagcctgtaatagctgataatcaatgccatagtccgggcgcaatcccagccgttgcgcctgcgtggcctgtagcaccatagctatctgccataaaggttgattatcaaaatggatcagcggcatacccaactcactgacccgtttttccagtgcgcttagctgcccggcgctgagacgttcgaccaacggcgggcatttggggagattgctgaatggcgtttcgttaccagaaatatccgcttcaacgaccagcgcgtcggcctggtgtagctttttcaccagctttgctggaagaggagccatatcgcgcgtccccatatgaatactgccaaccagatgcagatgacgaccgccgggcagggagagatcgatagcaggccaactatttggggtaccacgcagcgcgcgccataaacgtttaagttgatttaatagctccatacgcgctccctttgaaaaagctcatgctagcgcgttggagaaaagggcgcaatgcgccctgacgggacgtcaacgatcggtcgggttattcgctgccgtcgagataggccgttctggcgatggtcatttcaagctggcatttataaatactgatgcgcttttcagcgggtatggcctcggatttggcatcgctaagtttgccgcactgctgctctttttgggtcacccagactcgctgctcttgttttaatgccgttcgggcagaggcgggtagtgaattccagacctgattaagctcgcgatctctactttcaaatttctttgctgcgatttcaatcagtgagttattttttttctttataatgctatcaccagataccgtcattcttgccattacataaatagatcgcgccaatttatcggttttttgcacagaggtgacaacaatatctttgttgttgtctgctagctgaatattgtagttaacctgtttccaggtcaccgtattgtttattacctgtccatccccttgtgaaatatagaatagagtatttggtaagtctttcattaatttaaataatggctgaggaatacccatggcgacggtagccgagcaagttcgtaggttggcattttctgcttgagggttctgcgtgattacatcactgaattgaacaggaatagcccggagttgttgctcgtattgagtctgggggatatcgaagaaaagcgtggagggctctttaatatagtcttgctgtaaacgacctaatgcttcattgtaaatccattcttttgccgccgtgactgcattatcgttgccacattttaactctggagtggaatcaaataaccctgcataactgacggcgggagaaagcaggaaaagaagcgtaactgcttttctaaacataaataacacatccttatgattcaaaaaaacattataaaatgttgttttttatttttctacaggatgtgcggttaaatttttatatattgatacggtaaattactgatggcttaataatatatcaggcagctgatgctgcctgatatagcgtttttacgctttcggtttaaaacgcaatagccggttggcattgctgacgacggtaatggaagacagcgccattgccgcgcctgctactaccgggtttaacaaggtaccggtaaacggccacagaataccggcggccaccgggataccaatgctgttgtagataaatgcgccaagcaggttttgtttcatattgcgcaacgtcgcgcgcgaaatggccagcgcatccgccacgcccatcagactatggcgcatcagcgtaatcgccgcggtttcaatcgccacatcgctgccgccgcccatcgcgataccgacgtccgcctgcgccagcgcgggcgcatcgttgataccatcgccgaccatcgcaacctgacgaccctggctttgcaggcgtttaatcgcatcggctttgccatccggcagaacgcccgcaatgacttcgtcaatacccgcttctttggcaatcgcgttagccgtcgttgggttatccccggtgagcattaccagacggtatccggcgttgtgcaggcgttcaagcgcggcaatactatcgctgcgcaatggatcgcgtaccgccagtaacgccgccgctttaccgtcaatcgccagcaggaccggagtcgagccttgcgaggcctgcgcggtgatttccgccgtcatgtcatccgtggcgacgtgctgttcgttcagcaacgcctggttccccagaagcagttgatgaccttccgcttcaccgctgacgcccagtccgcgcagcgttctgaaaccgttcacctgcggcagtttatcatcgccggctttttccagaatcgcatgggccagcgggtggctggagccttgttcgagcgcggcagccagacgtaatgcctgagcttcctcaacgccgttaaaggtttttatcgccaccacttgcggcttgccttccgtcagcgtcccggttttatcaaaaacgagggtatccaacgtactggcgcgttgcagggcatcggcgtcgcgtaccagcacgccgaattcggcagcgcggcctacgccggaaataatcgacattggcgtcgccaggcctaatgcgcaagggcaggcgataatcagtacggtggtggcgatgaccagcgtataaacaatttgcggcgccggcccgaagaaataccagatagcggcgctgaacagcgcaatggccacgacgacgggaacgaataccgcggagattttatcggccagttggccaatttccggtttactgctttgcgcctggcgtaccatgcgaataatgcgtgacagcgtggtatggctgcccaccgcgctggcgcggaacaggacgctgccgtcctggacgacggtgccggcatgaacgctgtcgccttcgcctttttgctgcggaataggttcgccggtcagcatggcttcatcaagccacgcttcgccttgggtaatttcgccatccaccggcacgcgatcgccggtagtgagccgcagcagcatccctggctgaacgtccgccagcgggacgcttttttcgccgtcttctgtcacgacgcgtgcggtgggcggggtgagatcgagtaatttttccagcgcttttgaggaacgctgacgggcgcgcgcttccagcatgtgtccgagattaatcaaaccgataatcatcgcgctggcttcgtaatagaggtgccgcgcttccatcgggaaccactgcggccacaggttgacgctcatggagtagagccaggcaaccccggtgccgagcgccaccagcgtatccatcgtcgccgtgccgttcagcaggcttttccacgcgttacggtaaaagtgaccgcccgcaaagaccatcaccgcaagcgtgatcaggccaatagccagccacaggctgcggttgtcgtcggtcaccatcatgttatcgccgatcatcccccagaccatgaccggtataccgaccgcaagggcgacgattgcctgccaacgaaaacgtttcatggtggcgatggcggtttcctgctggcgctcgcggcgtttgatgtcatcttcaatcgcttctgcgccgtagccggctttttccaccgcctgcactaaatcagcggcggacgcgctgcccatcaccagcgcagtgcgttccgccaggtttacccgtgcctgcgtgacgcccggtacgctttgtagcgcatgttgtacgcgggtgacacaactggcgcagctcatgccgcttaacagcaactgttggctttcttcatcggccgtcgctaccggaagctcatgaggaaccgctgccagtgcttccgacgggattgatgactccgtcagcggtttagcctttgggtggcttaacgtcgcgccatacccggcttgtttgatggtttcaattaacgcgtccgcactggcggtaccggtaacgtgcgcttcggttacggtgacgtccgccagctcaacatccggacgttgttcaagactttctttcacgcgtttaacgcaatgaccgcaggacaaaccgtccagggtcaggtcgatagtttgagacatagtaaaaactcctttatgattggtcatcaattcattgaccttagtaatcgtagtgactcactgtgataaaggttaaaccttccagcaaggttaaggtcaagggggaaatatgaatattagcgatgtggcgaaaaaaaccggtttaaccagcaaagccattcggttttatgaagagaaagggctggtgacgccgccattacgtagcgaaaatggttatcgcacctacacgcagaagcatttaaacgagctgacgttgctgcgacaggcgaggcaggtggggtttaatctggaagagtgtggcgaactggtcaatctgtttaacgatccgcgacgccatagcgcagatgtgaaaaagcggacgctggaaaaggtcgcggagatcgagcgccatatcagcgagctgcaatcaatgcgcgatcaactgttggcgctggcggagagttgtcccggcgatgacagcgccgactgcccgattattgataatctttccggctgctgtcatcacaaggcgcaaaagccacgttgattaaacggcacgaatgcgtaaggtgatgccttccacggcgatcacttcgacatgcgtacctgcgcgcaggtcttcgtcagcgcataccggccacgagctgtcgccgacacgcatatgaccccgtccgttcactaacgcggcatcaagcataaaccggcggcctaccagttgttgtccgcgttggttaaggcggctgtcggtcggcttctgttcccgcacgcgacgcgccagccagcgccaccaaagccaggccgccagcaacgttaaggccgcaaacagcacgccctgccattcccagccgagcggtaagagccagacggttaagccggtaatcactgccgccacgccgctccacagcaaatagccgttaccgccgagcatttccgcagccaacaacaggccgccgaggctaagccagaagatatgcggatgcaccagaatcatcgctatcatgcttttttccgttcgctggcgctgtccttaaccagctcgctgatcccggcgatagcgcccatcagactgctggcatccagcggcatcatgaccactttgctgttattcgccgagccgatttgctgtaacgcttcggtgtatttctgcgccacgaagtagtttatcgcctgaatatccccggcggcgatggcttcagacaccatctgcgtagcgcgggcttccgcttcggcggaacgttcgcgcgcttccgcctgcaggaaagcggactgacgttcgccttcggctttcagaatctgcgactgtttttccccctcggctttcaggatttccgcctgacgtaccccttcggcctcaaggatataggcgcgtttggtacgttccgctttcatctgggcgttcatcgaggagatcaattccgcgggcgggcggacatcgcgaatttcgatacgggtaactttaattccccacgggttggtggcttcatcgacaatatgcagcagccgcgtgttgatgctgtcgcgctgggagagcatttcatccagctccatcgaaccgagtaccgtacggatattggtcatggtcaggttaatgatcgccagttccaggttactgacttcataagcggcgcgcggcgcatcgataacctgaataaaacagaccgcatcgatagtgacgttggcgttatcttttgagatcacctcctgcgacggaatatccagcacctgctccatcatattgatcttgcggccaattctgtccataaacggtacaacaaggcttaatcccggctgcagggttttggtgtaacgtccaaagcgctccaccgtccactggtatccctgcggaacgattttgacgcccgcgccgacgatcaccagcgcgacgaaaatgagaatagggataagaatgagcatagctaaacctcctgttgcgttgtccataaaccgattttgctgacgaattaagcgaattatacctgattcagtaaagcatgttccccccttattaattacagggatacactatcgctataaaaatatgaacaacggatgcgcaataaatgacagaacgtagcatgttgcttgagttaaagcaggtcggttaccggactgcgacgacaaaaatagtgaataacatcagttttacgctgcaacgcggcgaatttaagttaattaccggtccttctggctgcggaaaaagtacgttgttgaaaatggtggcctcgttaataagccctgatatcggcgtgattctttttgaggggcaggatattactactctgagtccggaagcctatcgccagcaggtttcttattgcgctcagacgccagcgctatttggcgatacggtttacgataacctgatttttccctggcaaattcgccatcagcgcccgcagccgacagccttcgcagacgatctggcgcgttttgaactgccggagacgattctgcaaaaaccgattaccgcgctttccggcggagaaaaacagcgtattgctctaattcgtaatctacagtttctgccgaaaatactgttactcgacgaaataaccagcgcgctggatgaacataacaaacggaatgtgaatgatattattcatcgctatgttcgcgataagcaggtcgctgtcttgtgggtaacgcatgataaagatgaaattcaacacgcggataaggtgataacgttaacgccatctgccggagagatgcaggaggcgcgttatgaacgagcataatattaccaatacctcgctggcgttatcgatgctgctggtggtggtcgcgatgctcatcagtcacaaggaaaagctggcgctggaaaaagatattctgtggagcgtatgccgggcggtgatacagctcattattgtcggctatgtactgaaatacatctttggcgttaatcatgccgccctgacgctactgatggtgctgttcatctgttttaacgccgcatggaacgcgcaaaagcgcagtaaatatatcgataaggcatttctctcctcgtttatcgccatcaccgtcggcgccgggctaacgctgacggtactggtgcttaccggttcgattgaatttgcgccgatgcaggtgattcccatcgctggcatggtcgccggtaatgcgatggtagcggtagggctgtgctacaaccaactggggctgcgttttcatagcgagcagcagcaaatccaggaaaagttaagtttgggcgcaacgccgaaaatggcctccgccgggcttatccgcgatagcatccgcgcatcgcttatcccgacgatcgactcggcaaagaccgttgggctggtgagcctgccggggatgatgtccgggctgatttttgccgggatcgatccggtaaaagcgattaaatatcaaattatggtaacgtttatgctgttgtcgacagccagcctgtctaccatcattgcctgctatttaacctaccggaagttctataattcgcgtcatcagttggtagtgatgccgctcaagaaatcatgatagttgccggatgatggcgcaagcgccttatccggcctgaggacgacaggtaggccagataagcgcgccatcaggcaagagaggattaatacagtagcgcgtacaactggcggcggtatttcgacgccagcgcgtcgccggtgccgagcgcggcaaggatctcctggaaggttttgcgcgtctgtccctcggcggcggtaagatcttttctcagatggctgaacagcaattccagcgcttcttcattacgtccgacctggtgcaactgcaatgccagttgcgttgccaaagccgcatcctgcggattgtccgcgacttgctgctgaagttgctgaatttccggcgtatccgccgcctgtttaagcagttcgatctgcgcaaccagcccctgataacgggtatcctgatcctgtagcgggatagtttttaacaccgcttcggcctcttcagagcggttcagcgcaatttgcgcttccgccagtaacaggccaatctcactgttctgcgaagagagctgccaggcgtctttgagcaacggcagcgcgtcaatgtagttgccctcctgcattaactgcatcgcttgttgcgcctttagctcttcttcgcgcggcagtactttatccagcagagcgcggatcgcctcttccggctgcggtccctggaaaccatcgaccggttggccattctggaacagatagactgtcgggatggcgcgcagcccaaactgagcggcgatcatctgttcggcgtcgcagtccagctttgccagaataaactgaccgtggtactgggcagccaggctttccagcactggcgttaattgcagacagtgttggctgcgttcagaccagaaatagaacagtaccggcgtggtcatggactgctctaaggtctgctgcaggttggattcattaatattgacaatgttctgtacggacatggcgtcgctctcttttgtctgtgtcacgtttacatgggggctgacgggcgcgcttcaactcagctttgtaaaattttatccagcatccggcccggcaatatgcgtttcagcgccatcaccgcccaggtgaccagcgtaacgggatagcgcagcctgggtttatcgcttgcaaaagcatgacgtactttcgctactaccgcgtcaggatcgcgggtgaaacgtgcggcgatgccgggattttctaccggtttatcacgctgcgtctggttaacgttatcggtaaaacgggtacgaatcggccccggttctatcaggctcactttaatgcctgtgtgccgtagctccatacgtagcgcgtcagaccaggcttcgagcgcatatttgctggcggcgtaagcgccgcgccctggggtggaaatcagccccatcaccgatgaggtcatcacaatgcgtccttcgccatgcggcaacatggcgggaagtaagcgcatagtaagctgatgcgcgccgaagaaattactggaaaactgttgctccatctgctcacggctgatggtggaaagggggccatacacgccgtagccggcattgttaaagatcccatacagacgattatcggtcagggcgatcacttcatcggcggcacgatccacgctttcaggggagtcgagatcgatcaacacgccggtaaatcccatactgttcatccgggcgacatcatcaggtttgcggcagcccgccaggatttgaaagccctggcgtttaagctcaagcgcgctgtccagaccgattccgctggaacatcctgttattaagaccgatttttgcataactttacctgtcaggatctccgttgatttaagagtcgtggttaactatatccgtcatacttcaagttgcctgtgcgttcgtttactccagtcacataggtatctatgctcctggacattctcttacgtgccgccttcatgcaactcgaatgattcaggagagaaaaggggtcaactgcttcgccatccagtcggcaataaacggctgggcgtcgcggttgggatgaatgccgtcatcctgcatccactgcggtttcagatatacctcttccataaaaaacggtaacagaggaatatcgaactctttggcgagcttaggataaatggcgctaaaggattcattataacggcgaccgtagttagcgggcagatgaatttgcatcagtaacggttgggcatcggcggctttcaccgtctgaatgattttacgtagcgtctgttcggtttgcgcaggcgcaaaaccgcgtaggccatcgttgccgccaagttccaccactacccagcgcgggtgatgctgttgcaacagcgccggcaaacgcgccagtccctgctgcgaggtatctccgcttatactggcattaacgaccgacgttttgttttgccatttatcattaaggagcgacggccatgccgcgctggcggccatacggtaaccggcgctgaggctatcgcccagaattaataaggtgtctgcggcggcggcacggaaagttaacaggatcaaaaacaggaagggcaaatgccagcggaaaacagtgttgaagttcatcgtctcaggaagtccgtcggtcagggtgagcatgagctttccatccttaccggagttgaactggttgtcaaacgcggcgaaaccattgcgctgattggcgaatcaggatcgggaaaatctacgctgctggcgattctcgccggactggatgacggcagtagcggagaggtcagtctggtcgggaaaccgcttcaccagatggacgaagaggcgcgggcgcagcttcgcgctcagcatgtcggttttgtttttcaatccttcatgcttattcctacgcttaacgcgctggaaaacgttgagctaccggccctgctacgcggtgaaaacagcggtcagagtaaggcgggggcgaaagcgctgctcgaacaactgggactgggaaaacggcttgaccaccttccggcacagctttccggcggcgaacagcagcgcgtagcgctggcgcgcgcgtttaacgggcgtcctgatgtgctgtttgccgatgagccgacgggcaaccttgaccgtcagaccggagataaaatcgccgacctgctattttcgcttaaccgcgagcacggcaccacgctgattctggtgacgcacgacccggcgctggcggcgcgctgcgaccggcggctgcggttggtcaacggtcagttacaggaggaggcatgatagctcgctggttctggcgcgaatggcgctcgccgtcgctgattattgtctggctggcgttgagtctggcggtggcctgcgtactggcgctcggcagtatcagcgaccggatggaaaaagggttaagtcagcaaagccgcgagtttatggcaggcgatcggacgctgcaaagttcgcgggaggtaccgaaagcctggcttgaagaggcgcgtaaacgcggccttaacgtgggcgagcagttaacctttgcgaccatgacgtttgccggcgatacgccgcaactggccagcgtgaaggcggtagatagcgtttatccgatgtacggcgaattgcaaacccgtccaggcggagtgaaagcgcagccgggtagcgtactgctggcgccgcgtctgatggcgctgcttaatttgaaaacgggcgataccattgatgtcggcgacgtgaccttgcgtattgccggtgaagtggtgcaggagccggattccggatttaacccttttcagatggcgccgcgtctgatgatgaatatggccgatgtggcaaaaaccggtgcgatacagccggggagccgcgtgatgtggcggtataaattcggcggaacgccgcaacagcttgctggctatgaaagctggctgttaccgcagcttaaaccggaacatcgctggtacggactggagcaggatgacggggcattggggaaatcgctcgaacgttcgcagcagtttttgctgctttcggcgttattaacgctactgctggcggtagctgccgtcgcggtggcgatgagccattactgccgtagccgctacgatctggtggcgattttaaaaacgttgggcgcgggccgggcccagttgcgtaaacttattatcggacagtggttgatggtgctggggctttccgccgtcacgggaggcgcgattgggttactgtttgaaaacatattgctggtgctgctaaaaccggtactgcccgccgatttgccgcccgccagcctgtggccctggctgtgggcgctgggcgcgatgacggtcatctctctgctggtcggtttacggccttatcgattgttgctggcgacccagccgctacgggtgctgcgccgcgatgttgttgctcgcgtctggccgttaaaaatttatttgcctgtcgcctgcgccgtcgtggtggcgttgctcgtcggattgatgggcggaagtatgctgttgtgggcggttctggcgggcgccgtgatactggcgctgctgtgcggtctggtgggctggatgctgcttaacgtgctgcgcggcatgacgttgacgtcgctaccgctgcgtctggccgtcagccgacttctgcgtcagccgtggtcaacgttgagtcagctttcggcgttttcgctttcgtttatgctgctggcgctcttgctggtgctgcgcggcgacctccttgatcgctggcaacagcagctcccgccggaaagtccgaactatttccttatcaatattgcttcagaacaggtcgcgccgctgaaagcctttttggcggaacatcaggtgatcccgcagacgttttatccgattgtgcgggcgcggttaacgaagataaacggtaatccgacggaaggtcagcaggatgagtcgctcaaccgtgaactgaatttgacctggcaggatacgcgcccggcgcataatccgctggtcgccggtcactggccgccaaaaccgggcgaagtctccatggaagaggggctggcgaagcggctgaacgtcaaactcggcgatagcgtaacctttatgggcgatacccaggcatttagcgctaaagtcaccagcctgcgtcaagtggactgggaaagcctgcggcccaactttttcttcatttttccttccggggcgctggacgggcaaccgcaaagctggttgaccagttttcgctgggagaatggcaacggcatgttaacgcagcttaaccgcgagtttcctaccgtcagcctgttagatatcggggcgatcctgaaacaggtgggacaggtgctggagcaggtcagtcgggcgctggaggtgatggttgtgctagtcaccctctgcggcatgttgctattactggcccaggtacaggtcgggatgcgtcagcgccatcaggagctggtggtgtggcgcacattaggagccggaaagaaactgttgcgtaccacactctggtgcgaattcgccatgctggggttagttgccgggctggtcgccgcgattggcgcggagacggcgctggcgatcttacaaatcaacgtttttgatttcccctgggagccggactggcgtttatggggcgcactgccgttttgcggcgcgctgctgctttccgtatgcggcggctggcttggcgttcgtttgctgaaaggcaaagcgctattccgacagtttagcggatgattcatgatgtgaataatttcgcgccggtttttaaaacggcgcgtacttttttagtcgcacaaattgataactccttgatttttagtagcacaaatcattaaaaaatacacaacacgtaaggttttataacagttattatttgcctgctaaatgatttggattggctatctatcaaggaaaatataatgacaattaaaataacagcgttggcggcatcgatcggcgcggcagtggctttcatgcctttcgccactcaggcggaaatcaccgttttaaaacaagatccccaggcgggtaatccactcagccgactcaatttcaccgttggcgggagtattcgtccgcagttccagaatatgaccggcaatgacggcgcgaacggttataaacgtaatggttttgatggcgggacgcgtttccgcttcgccgcggattattatctgtttgatgatatcagttggattagctattacgagctgggcgtcaatatccctgcggtatttgactgggataaccattatgcgaagggcgcgactgataccactcgccgtatgctgtataccggcttcaagagcgcgacgtggggaacgctgaccttcggtcaacagaacagcatttattacgatgtggtgggcgtaaaaaccgatatctgggattacgacatgataggtcaggcgccgggcaacgggattaacggcgactacgatggttcttatcgcacgcgtaagtcattgaagtataagaaaagcattggcaatgtcgatctctacgcgtcttatctgttcagcgacgattataatgccaataacggcctgaattacaagcgtaaaggcggcggttctttaggcgcggattaccatctcaccgacgatctgacctgggggacggcatggaactatacccgtgcggagatgcgcggcaacggcaataaaacttacgatcaaaatattgtcggtaccgcgttaagctggacgccggaaaactggactatcgccgcaggcggcggttggtatcagaactttatgacgaccaaaaaagtgtctgtgaatgattactttgccggcgatgcgtggggtctggaatattttgtcggttacgctttcccgattggtcagtatgccgtgaaagctattcaaccgtactttatgggcgaccgcattgaatatgtgaatggccgcgactatctgcgcaccgataacggcgtggggatcaccttccaactggattatggtttccgcgttgattatgaacatgttttcacttccagcactgacaatctgggcgatatgaacctggtgcgtctgcgttacgatttctaaagcgttttcctctgccggatgttggcgttaagacctcttatccggcatttccctttacgccattcccgcctgacacacgcctgagcgcctgcctcgtacatttaacgacacaccaggaaacatcatgaaataatttcaaggacagcaggctgtgatctgtgtcatgttaagaaatagcctttcgtttgggccaaaacagacgatgccgcatgaacggcatccggcacagcatcacactatttaaaatggagaaattatgggattgcgtcagagtttacgcattgcggccagcacgctattactggcctgcggattacagtttgcccatgccgatagttccccgcaaacgatcgtatttggcgtcgcgccagggccgtatggcgacatggtgaagcaggcgattgcgccgacattaaaagaaaaagggtataaggtcgtggtgcgcgagtttagcgactatgtccagcccaatatggcgttagctaatggcagcatcgacgccaacctctttcaacataccctctattttgacaaattcaccgctgacaaagggctgaagctcagcaaacttattgtggtaccgaccgccgggatgggcttctattcacgtaaaatcaacagcctggatgcgcttaaaaaaggggacattattaccctctccaacgatccgaccaacctggcgcgcggccttcgcttcctgcaatcgttggggcttatcacgattaaggacaatatcgatccgaccaaagcctctgaacgagatatcgccagcaatccaaaaggactggttttcaaaccgctggaagccgcacagctaccgcgcacgctggatggcgtgaccggcgcgctggttaacgggaactttgcggtggcggcaggactcgatctctccagcgcgattaagcaggaacacctggatgagaatctgaaaaatatcattgcggtacgcagtgaagatgccgataagccgtttgccaaagatattgtcgaggcggtgaaatcgccggcttatcgcgcggttatcgacgatccaaagaatatttatagcgccttccagaaaccggaatggatgaccgcgacaccctgatcgcagcggtggccatccccaatttctgaggtgaatatgattgaaatagaaaaagtctgcgtcgattttaccgccggtcgcggtacccccacgcgcgcggtggatgatgtgagcctgcatatcgccgcgggcgagatttttggcattgtcggtaccagcggcgcaggaaaaagcactctgctgcgtaccctgaacgccttaacgcgtcccagtcaggggcgcgtcaacgtcaacggcgtggaaatttcggcgctggacggaaaagcgttacgccaggcgcggcagcgtattggtatgattttccagcattttaacttaatgcatacccggacagtggcgcaaaacgtggcgtttagcctgaaagcggctggctgggaacgcagcaaaatcgcgccgcgggtggcggaaattttaacgctggtgggccttgccgataaagcgaaccgttttccggtacagctcagcggcgggcaaaaacagcgggtggggatagcccgcgccatcgctaaccatccggatgttttgctgtgtgatgaaccgacttccgctctggatctggaaacttccgccacgattctggccctgctcagacagatcaacgcacagcttgggattactattgtgctgatcacccatgaaatgaacgtgatcaaatctatttgcgatcgcgtggcggtgatgtcgggcggtaaggttgtggaatcgggcgaggtgtttgatgtgtttgcccacccgcaacacgctttcacacagcaactggtgtctcatacccttaatttgaccctgccggaacgtttacgggaacacctgcccgggcagctgctgaaaattttgtttatcggcgattcggcggagcagccggtactgtcggaggtggcgatcaagtttggcgtcgcggtcaatatcctgcatggcaagattgagtatatcggcgaacgcgcgttgggcattctggtggtgcaattaaccgcgccgcataatccaacggcggtggccgccgccgtggagcatatccgtcaacgtactgcacaggtggaggtgatccgtggatgatttattgccggatttaacgctggcgttcaatgaaactttccagatgttgagtatttcaacggtgctggcgattcttggcggtctaccgctcggttttctgatttttgtcaccgatcgtcatctgttctggcagaaccgttttatttatctcgtcgcctcggttctggtgaatattatccgctcggtgccatttgttattttactggtgctgttactgccgctaacgcagcttttgctgggcaatacgataggcccgattgcagcctccgtcccgctgtcggtggccgcaatcgcgttttatgcacgcctggtagatagcgcgctccgtgaagtcgataaagggattattgaggcggcgctggcattcggcgctagtccgatgcgtattatctgtaccgtactgttgccggaagccagcgcagggctgctgcgcggcctgacgattacgctggtaagcttaatcggctactcggcgatggccgggattgtcggcggcggcggggtaggcgacctggcgattcgctatggctactaccgttacgaaaccgaagtgatggttgttaccgtagtggcgctgattgtgctggttcaggtcgttcagatgctgggcgactggctggcaaaacgtgccgacaagcgcgacagacactaagccggctcaatgtagcgtcagccggcaataaaagtaagctattgcgcttttagccagttggcaacgtcttgccatgtgccgcgaaaaacgatattcgcggcttttttctccagttgatagcgatacattgggtcgtaatattcgttaagtagcggaaccagccatgccatatggccgtcagtgctgccgctggataattgctctgccagcgccctatccagcgtgtccgtcagttcggcaaagcgttgcaaccccagacggcggcgaatagcgaacagtccatgatgaagatattcactatacgcctgccaaccggcttcatcgccgtaggcgtgggtgaagtcgtgatgcatacggatgaaatactcttcacgcagtcgttccagacgaagcgcaaacggatcttccactaccgcaatgggggcctgcgccattctttcgcgtaaacactcaggcagatggttggcgccgatcgttcgcccttcatcttccagtacccacctttttagcgtctgacgcgcgttaattttcagcaattcaacggcaagtttgttttcaaaactggcctggctgagctgggggttcagcgtgcggccaaaagaggagccgcgatgacgcgcgagaccttccagatccacgccgttgggctgttgtcgtaccagttgcgttttgccgctgcccgtacagccgccaattaaaagtatcggtttttgcgccagttgccaggtcgcctgaattgctgtctggcgcagcgctttatagccgccttcaataagcgggcagtcaatccctgtttcttgcagccaacgttgtacgatatgtgaccgctgaccgccgcgcgcgcagcacagatacccgttggggaaacgttgatacgcggctttccaggcctcaagccgctgctggcgaatgtcgccgcaaaccagccgatgccccagcgctaacgccgcatccgcgccctgacgtttgtagcaggtgccgacggcggctcgctcgtcatccatcatcaatggcaggttgatagcgcccggcatggcgccctgttcaaactcaatcggcgcgcgtacatcaattaaaggcgtatcggcaaggaggagcgcgcgatagtcctgtgctttttgtctgtcttgcataacgtaaaacgtaaccttaaatcatcctttgcgctattttacgcgccaattcgcaaagtggcttgatttttaacagcgtaccgtgttgaaaatggataaaaaaccggctatttcgggttgccgttgggtaaataatttcacaatgtcttctaccgctttgcctccgccaaatttatgccaggcgaggcttaacggtgagggcggacgcatcgtcgggatggtacagctcaccagttcgtttttgtcgatcagcgtttgacaaagcggctgcgggacaaaaccgataccgacgcctgccagatgagcggcgattttggtttccatatcaggcacgataatttccttctgccccggaaggcgccaggctacccgcttggtcagcgtacgcgcgctgtcttcgatattaattgccgggaaacggcgcaactgcgcttctgttagaggcccgctgacgtgagctaaaggatgatccgcggacatcacaaaacgccattgtacggaacctaaagggtcgagcataaaggtattagccaacggctcggtgccagttacgccaatcgccagcgaaaaaccttcatacaggagcgaatcccagacgcccatataaatttgccgggaaaagtgaaactgggtgaaagggtaacgcgcattaagccacgataagagactggcgaccgcttgcgggctatagagcaggttattcaccacaatattgacctgacgctctacgccgtcgttaacctggcgtagctcgtcaggcatgctgtccagccacgcaagccagtcttttgcctgagagagaaggtgagagcccgccgccgtcaacgagacgcttcgcgttgtgcgaaagaacagccctacgccggtattttcctccagcagtttgatgcggtagctaatggttgccgtggttttacacaggcgctccgccgctttggagaaactccccgtttcggcaacgctgataaaggtacgcagtgtttccgggtcaaacatcgtcagacgcctccttacgatcctgataaaaccagaattgttttcctatgatttttaagtagttttacataatagccatgtttgatttgtggtctaaatctacttttggaaaaatattccaacttttatgttgatgttaaatcccgaaggttttagattgcatggtattgaaaccggacagagtccaaaccgcggttaaacggaatcgagctacaagggaaaaataatgaaacttgaggtattaccgttagatcagaagacgttcagcgcttatggcgatgttattgagacgcaggaacgtgaattttttcatataaacaacgggttagttgagcgatatcacgacctggcgaaggttgaagttctggagcaggatcgcacgctgatcagtattaacagggcgcaaccggccgcgatgcctattgtggtacatgaactggaacgtcatcctttaggtacgcaggcgtttgtgccgatgaacggcgaggcttttgtcgttattgtcgcgctcggcgatgataaacccgatctctccacgctgcgggcgtttattagcaacggacggcagggcgtcaattatcaccgtaatgtatggcatcacccgctgtttgcgtggcagacggttaccgattttctgacggtggatcgcggtggcagcgataactgtgatgttgaaagtatcccgacacatgaactctgttttgcgtgacgctattggccttcttgcataagatgaacatattgttcattgtttatgctcatattttgggccggagttaacgtaaatatgacggaagtaagacgacgcggcaggccaggacaggcagagccgactgcgcagaaaggcgctcaggcgctggagaggggcatagcgatattgcaatatctcgaaagaagcggcggcagttcatcagttagcgatatttccggcagcctggatttaccgctttctacgacgtttcgcctgttaaaggtactgcaagcggctgattttgtgtaccaggatagccagcttggctggtggcatattggtttaggcgtatttaatgtgggctctgcgtatattcataatcgcgatgtcctctcggtagccgggccctttatgcaccgacttatgctgctttctggcgagacggtcaacgtagcgattcgcaacggtaatgaagcggtgttaatcggtcaaaaggagtgcaaatcgatggtcagaatgtgcgcgcccttagggagtcgtctgccgttacatgcttccggcgccggaaaagcgctgctttacccgctcaccgaagaagagctggtggggatcgtcgtcaataccggtttgcggcggtttacgccgaccactctggtggatttacctatcctgcttaaaaatctggagcaggcgcgtgaacagggctacaccgtcgaccaggaagaacatgttgtcgggctgaattgtatcgcctccgctatctatgacgatgcgggcagcgtggtcgccgctatctcgatatcgggaccggcttcccggctgacggaagatcgctttatcagccagggtgaactggtacgggataccgcgaaagacatcagtacggcgcttgggctaaaaccccctgtagcctgagccgcatcccgctcgctggagcgggacttttttaaaatttttaaaagttggaaactttttccaataaaaagaggtagcaataaaatggcaaaaatgagagccgtggatgcggcaatgtatgtgctggaaaaagaaggtatcaccacagcattcggcgttcctggggctgcaatcaaccccttctattctgcaatgcgtaagcatggaggcattcgccatatactggcgcgtcatgtggaaggcgcttcgcatatggctgagggctacacacgtgcggcggcaggtaatattggggtctgcctgggcacttccggcccggcgggaaccgacatgatcaccgcgctctattccgcttctgccgactccatcccgattttatgcattaccggccaggcgccacgagcgcgtctgcacaaggaagatttccaggcagtcgatattgaagcgattgcaaaaccagtcagcaagatggcagtgacggttcgtgaggcggcgctggtgccgcgcgtattacaacaggcttttcatctgatgcgctcaggccgcccaggtcctgtgctggttgatttaccgtttgatgtccaggttgcggagatcgaattcgatccggatatgtatgagccgttgccggtatataagccagccgccagccgcgtacagattgaaaaggcgctggagatgctgattcagtccgagcgtccggtaattgtcgcgggcggcggggttattaacgccgacgccgcgccactgctgcagcagtttgccgaactgaccaacgtaccggtgatccctaccctgatgggctggggctgtatcccggacgatcaccccttaatggcggggatggtcggcctgcaaacggcgcaccgctacggcaacgccactctgctggcatccgatatggtttttggcatcggtaaccgcttcgccaaccgtcatacggggtccgttgagaaatatactcaggggcgaaaaatcatccatatcgatattgaaccgacgcaaattggtcgcgtgttgtgcccggatctaggcatcgtttcggacgccaaagcggcgctaacgttgctgatcgatgtcgcgcaggagatgcaaaaggcggggcgtttgccatgccggaagacctgggtggacgaatgccagcagcgtaaacggactttgctgcgtaaaacccactttgacaacgtgccagtgaagccgcagcgcgtctatgaagagatgaacaaagcctttggtcgcgatgtgtgctatgtcaccaccattggattgtcgcaaatcgcggcagcgcagatgctgcatgtgtttaaagacagacactggatcaactgcggccaggcggggcctcttggctggacaatcccggcggcattaggggtttgtgctgccgatccgcaacgcaatgtggtggcgatttccggcgatttcgacttccagttcctgattgaagagttagccgtcggcgcgcagtttaacattccgtatatccatgtgctggttaacaacgcttatcttggtctgattcgccagtcgcaacgcgcatttgacatggactactgcgtacagcttgcctttgaaaatatcaactccagcgaagtgaatggctatggcgttgaccatgtaaaagtggcggaagggttaggctgtaaagcaattcgtgtctttaaaccggaagatattgcgcctgcatttgaacaagccaaagcgctaatggcgcaatatcgcgttccggtggtggtggaagtcattctggaacgcgtaaccaatatttccatgggcagcgaactggataacgtaaccgagtttgaagaggttgcggatagtgcgaaagatgcgccaacagaaacctgttttatgaaatatgagtaagggaggtaatcgatgttacgtttctctgccaatctttctatgctgtttacggaatatgatttcctggaacgctttgataaagcggcgttgtcgggatttcgcggcgtggaattcatgtttccctacgataacgacatcgaagtgttaaaacgtaagctcagggataataatctggaacatacgttacataatttacctgctggcgactgggcggctggcgaacgtggaattgcctgtattcctgggcgcgaagaagagtttcgcgatggcgtagcggccgcaatccgctatgcacgtgcgttaggcaataagaaaataaattgtctggtgggtaaaacgccgtcaggattctccgcaacggagatccacgacacgttggtcgaaaacctgcgctatgcggcaaatatgctggcgaaagaagacattttattacttatcgaacctattaatcactttgatatgccgggattccatctcaccggcactcaacaggcgttagcattaattaaggatatcggcagcgataatatcaaaattcagtatgatatttatcacatgcaacgcatggaaggggagttaacgcaaaccatgacggcatgggccgataaaataggccatttacagattgctgataacccgcgtcgcggcgagccggggaccggggaaattaattatgactttatttttaatgtcattaaacagtctggttatgatggctgggttggctgtgaatataaaccactgactaccacggaagcgggattatcgtggattaatcagtaccgttaaaacgcagaataattcgggcagcgcttttttttccactgtgttggaaggggattgtgttgcctgaatctggaaacaccgaaagcaataaaagaggttgtatatgaaactgggatttattggcctgggaattatgggctctccaatggctatcaatttggcacgcgccggtcatcaattacacgttacgactattggtccggtcgcggacgaactgctctcgctgggggcggtaaatgttgagactgcacgtcaggtaactgaatttgcagacattatcttcataatggtgccggatacaccgcaggttgaagacgtgttatttggcgaacacggttgcgctaaaacatcgcttcagggaaaaaccatcgtcgatatgagttctatttctcctatcgaaaccaaacgttttgcccagcgcgttaatgaaatgggcgctgattacctggatgccccggtttccgggggagaaatcggggcgcgtgaaggcactctgtcgattatggtcggcggcgagcagaaagtctttgaccgcgttaaaccgctctttgacatcctgggaaaaaatatcaccctggtgggcggcaatggggatgggcaaacctgtaaggtggctaaccaaattattgttgcgctgaatattgaagcggtttctgaagccttagtgtttgcttcaaaagcaggcgccgatccggtacgcgtgcgccaggcgttaatgggcgggttcgcctcttcacgcattctggaagttcacggcgagcgcatgatcaaccggacgttcgagcctggtttcaaaatcgcgcttcatcagaaagaccttaatcttgcattgcaaagcgcaaaagcgctggcgctgaatttaccgaatacggcgacctgccaggaattattcaatacctgtgcggcaaatggcgggagccagcttgaccattcggcaatggtacaggcgctggaattaatggccaatcataaattgtcctaattatgtgtatcgctgcggctgcagcgatacctgttcacaaggaacactctgtaaaggtgaagaacatgagtgaaactaaaaaatccggaattgattactggaaacaaattgttgtcgtaatgagtctgggctgggtagcgatttggatctatcgcaccgtgcttacgccaatttatccagaaattcaggcatctttagacaatgtaagtaatgctgaaataggcgccattgcaagtttttacttttttgcttactgcagtatgcaaatcccttgcggaatattggtcgataaattcggtcaaaaaatcatgctgatggccggatttacgctttttattattggtacactctgtatcgcgaaagccaatggcctgaccatgatctatatagggtcgctaatggcaggtggcggatgcgcttctttctttagctcggcttattcactctcttcggcaaacgtgccgcaggcccgtcgggcattagccaacgcaattatcaacagcgggtcggctatagggatggggattggcttaatcggttccagcatattagtaaaaaacatgagcatggcctggcaaaatgtactgtatatcgtggccgcgatattagtaatcatgctgtgcgtctttacgctgatcattcgcggtaaagccaaaagcgactctgcgcaagcggaaaagcaaacccaaaccgttacggaagatgagaaacgcgcgcctttattctctggtttattgtgtagcgtttacttcctctatttctgtacctgctacggttattatttgatagtgacctggctgccctcttatctccagactgaaagaggatttgatggcggagctatcgggctggcatcagcgctggtggcggtggttggcgtaccgggggcgttattttttagccatctgtcagataaattccgtaacagtaaagttaaggttattctcggtctggaaattgtggcggcagcaatgttggcgtttacggttttgtccccgaataccacgatgctgatggtcagcctgacgctatacggcttgctggggaaaatggcggtagacccgatcctgatctcctttgtatctgaacaggcttcggcaaaaagtctgggaagagctttcagcctttttaacttctttggcatgagttcagcggttgtcgccccaacgttgaccggatttatttcggatgtaacggggtcgaaagagatcagttttgtgatttcagcatgtttagtggtcaccggaacgctgatctttgctgtcgtcactttatataaaaagaaagcaacgcaacgtattgcttcagcttaaaaataattatatctactaattctttattttatatttatttgttcctcatagctaaacccataacaacgttatccgatgcgtgaaaagagggatttatggaacatcaaagagagctataccagcagcgcggttatagcgaagacttattacctaagacagaaacccaacgaaactggaaggcatttaactatttcaccttatggatgggatctgtacataacgtgccaaattacgttatggtcggcggtttttttatactggggctatcaacatttaatatcatgttggccattattatcagcgcattatttattgcggcggcgatggtaatgaatggcgcggcaggcagcaaatatggcgttccttttgctatgatattgcgaggttcttacggtgtccgcggcgcgctattccctggattattgcgagggggaatcgcggcaattatgtggttcggcttacagtgttacgcgggatcgctggcatttcttattttgattgggaagatctggccaggatttctgacattaggcggagatttcaagctgctgggtctttcactgccaggactaattacttttctaattttttggattattaacgttggcatcggttttggcggtggtaaagtattaaataaatttaccgctatcctcaatccatgtatttacattgtctttggcggcatggctatttgggcaatatcgctggtcggcattggcccgattctggactatctgccttcaggcgtgcaaaaagcagagcacagcggctttctgttcctggtggtgattaacgccgtagtcgccgtctgggctgcgccagcggtaagcgcgtccgatttcacgcaaaacgcgcattcatttcgcgctcaggcattgggacaaacattggggcttatcgtagcgtatatattattcgccgtagccagcgtgtgcattattgccggagccagtattcattatggtatggatacctggaacgtgctggatattgtgcagcgctgggacagcttgtttgcttcattctttgcggtgctggtgattctgatgacgacaatttcaaccaacgccaccggtaatattatacctgcggggtatcaaattgcggcgcttgccccgacaaagcttaactataaaaatggcgtaatgattgccagtattatcagtctactgatttgcccatggaaattaatggagaatcaggacagtatttatctgttcctcgatattatcggcggtatgcttggcccggtaatcggcgtaatgttagctcattattttgtggtaatgcgtggaaaaattaatcttgatgagctgtacaccgccagcggtgattacaaatattatgataatggatttaacctgactgcattttcagtcaccctagtcgcagtcattctgtcattaggcggcaagtttataccatttatggagcctttatcccgcgtgtcctggtttgtaggcgtaatagttgcgttcgttgcttatgcgctattgaagaaacgcacgggttttgaaaatacaggagagaaaaaactcgcaggttaaatattgaaaaagcattaagcgtatttaatgaagtgtgcgctatttaaaaactatctgtatccatacaaggagtttgttatgtcttttgatttaattattaagaacggtactgtcatcttagaaaacgaagcgagagttatcgatatcgccgtccagggcggaaaaatcgccgcgattggcgagaacctgggggaagcgaaaaatgtgctggatgcgacgggattgatcgtttcgccgggcatggttgacgcgcatacccacatttctgaaccgggccgtacccactgggaaggctatgaaaccggtacgcgcgcggcggcgaaaggcggtattaccacgatgattgagatgccgctcaatcagctgccggcgacggtcgatcgtgagacgattgaactcaagtttgacgcggcaaaaggtaaattgaccatcgacgccgcgcagttgggcggtttggtctcttataacctggatcggctgcatgagctggacgaagtgggcgttgtcggcttcaagtgctttgtcgccacctgcggcgatcgtggcatcgataatgattttcgcgacgttaatgactggcagttttacaaaggcgcgcaaaaactgggagagatggaccagacggtactggtacattgcgaaaatgctctgatttgcgatgagctgggcgaagaagctaaacgcgaaggtcgcgtaacggcgcatgattatgtcgcctcacgtccggtatttactgaagtggaagccattcgtcgcgtgctgtatctggcgaaagcggcaggttgccgtctgcacgtttgtcatatcagcagcccggagggggtagaggaagtaacgcgtgcgcgtcaggaaggccaggatgtcacctgtgaatcgtgcccgcactattttgtcctcgataccgatcagttcgaagagattggcaccctggcaaaatgttctccgccaattcgcgaccaggaaaaccagaaagggatgtgggaaaaactgtttaacggcgaaatcgactgcctggtatccgaccactctccatgccctccggaaatgaaagcaggcaatatcatgcaagcatggggcggaattgccggactgcaaaactgcatggacgtcatgtttgatgaagcggtgcaaaaacgcggtatgtcgttgccgatgtttggcaaattaatggcgaccaacgccgccgatatttttggtctgaaacataaaggacgtattgcccccggcaaagatgctgacctggtctttattcagcctgacagcagctatgttctgaaaaatgaagatctggaatatcgccataaagtcagtccgtatgttggccgtactattggcgcgcgtattaccaaaacgattttgcgcggcgatgttatttatgacatcgagcatggcttccctgtgccgccaaaaggtcagtttatccttaaacatcagcagtaatccggtgtgatttaatgcccgtcgtcacgacgggcattctctattttaaggtgtggatatgttccctgttattaaccgcgaaagtgtgttgtccggctttcagtggtttttctttattttctgtaacactgttgtggttccccctaccttgctatccgcttttcatcttcccgctgataacctgttaatgctcacacaatacgcttttttgaccaccgcgttggcctgcctggttcaggcattttgcggccatcgccgtgccattatggaagggccgacagggctgtggtggggcgctattcttacgattacgcttggcgaggcgtctcgcggcacgccgctgaacgatatcgcctccagcctgtcggtcgggatcgcgatctccgcaatggtgacgatatttatcggcattagcgggttaggacaccgtctggctcgcctgtttacgccggcggtaatggtttttttcatgctgcttttgggcgcgcagctgacctcaatattttttaaaggcatgctggggctgccttttggcattgccgataccagcgccagaatcaaattggccccctttgggctggcggtcgcggtgatgtgttttatcctcgcgatgattattttcctgcaacagcgtatctcccgttacgcgttactggtagggaccgtggtcgggtgggggctatggcggttatgctttccttcatcacacttaccgccgggtgaattaagctggcgatggtttcctctgggcagccacggcacgctgatgccgggtattattgtgacggcggtgatgacggggttagtcaacatcagcaacacttacggcgccatccgcggtaccgatatcttttatctgcatcaagggtcgggcagttctcgttatcgccgaagctttatgatttccggactgatgacgttagtgacggtgcctttcgcggtcgtgcctttttcgccttttgtatcttccattggtttattaacgcaaaccggcgacagttctcgcaaatcctttatctgcggtagcgcgctgtgtctgctggttgccattataacgccgttaacccgcttattttgcgctattccactggcgatcagcagcgccgttatgctggtctcttatttacctttactttattccggtttggtttttagccagcaaattacgtttaccgcgcggaatatttatcgcctggcattaccgctttttgtcggcatttttttgatggggcttcctccggtctatttacaggatcttccactgatgattcgtcctctgcttagtaacggattactggtgggaatcttactggcagtgcttatggaaaatcttattccgtgggaacgcattaaataacatgagaaaacaaggagacatgatgaagattgtaattgcgccagattcatttaaagagagcttaagcgctgataaatgctgtcaggctattaaagcgggattttcaaccgtatttcctgatgcgcgctatgtctgtttaccgatcgccgatggtggagaaggaaccgtggacgcgatggtggcagcgaccggcgggaaacgggtttctgtggacgttagcgggccgatgggggaaaaagtaaacggattttatggcctgaccggcgacggcaaaacggcgattattgaaatggcggcggcgagcggattgatgctggtggcgcccgaggcgcgtaatccgctgctggcatccagtttcggcaccggcgaattgattcgtcacgccctggacgcggggattcgccatattattctgggtatcggcggcagcgccacggtggatggcggaatgggagtagcgcaggcgctcggtgtgcgttttctggacgcgcaaggaacgccgcttggcgccggagggggcaatttatcgcgcctggcgagcattgacctgcaggggtgcgatccgcgaatttcagagtgtcgtattgaggtcgcctgtgatgttgataacccgttggtggggccacgcggcgcggcggcggtattcggtccgcagaaaggggcgacgcctgaaatggttgagacgctggaaaatggattacgtaattatgcccgtgttttacatgccctgaccggacgcgacatgtctcaaataccgggcggtggagcggccggaggaatggggattgccgctatcgtcttcctggaagcggaaatgaagcccggtattgagattgttatgcaggcggtgaagctggaggaggcggtaaaagaggcctcgctggtgattaccggagaagggcgaatcgactcgcaaacggcgggaggaaaagcgccgataggcgtcgcgtcagtggcgaaacggcatcatgtcccggttatcggcattgccggcgtactgggcgacggcgtggaagtggtccatcgccacggtattgatgccgtattcagtattttgccgcggctggcgcctttgccggaagttctggcgaacggtgaacaaaatctctaccacagcgcctgtaatattgcccgcgtcatcaaacttggccaggacatcgggactcgttaagcataaaaaaagccacggttctcaccgtggcaaaatccaacatagctaaattaaaaataatcaggagggctgcccgccgttaaatcataacgtcgcggttacagtctttggagtagatgtagctgaatgcttcgccacgacctacaccgtatccggcctgcagggaataagcacccatgaagatgtagtcgccttttttcaccggcacccagttgttgtcgaggttataaaccccctggccggaaaggatataagcgccatgttcctggacgtgggtttcaatatagccgtggctggcgcccggttcgaacgacagaatatgcatattcatatcgaagcccagctctttaggcaggaaatccagcagaataacatcttccatgccttcataatgaatacgctccagctggctggcattgccggaaaccaaccacggggcatgcccctcgacaggagtatagcggcgtttatataaaaatagctggctgtcttccgtttgagcgttgctaaaggtcatcatctcgcccggtggacaatagaggtatccgccctgggttaaagagaatgtttttccttctgctttagcttcaatatttcccgcaatgacatagagaaaagtttcaatcccctcgccgccaaagccctgctggttgccgccattctgatgtaaggtgaccagataatcgacgaaagaagcacccagcttcggcgtcgaaaggatggtgacgtcacagttttcaaagccgggaataatatttttcaccagaccgtccggcgttaagagcgcatagttaccgtgtttcacaatggcgcggttcgccagtaaatcatcgcggtaacccgtgacgttattcagatatcccattgatggctccttatttttgccaggcaagttgatgcagcattaatgccagagttttgaccccttcagcaaggtcattaatgttggtacgttccgccgggttatggctgataccattaatgctggggacgaaaatcatacaggtagggacgcgcggcgcgaaaatttgcgcgtcatgacctgcgccgctatgcattatgcgatagttcagttgttcggtttcacacagcctggtgagggccgcgaccagttcggcgttcatcggcaccggcgcttcgtccatccacaaatcgatatcgatgctgatatccatttcatcgcagatggcgcgcatatcgttttccaactgttcggtaaattcgcgaagtacggcggcgtccgtatgccggcaatcgattgtaaatgtggtttttccagggactacattgaccgtattcggctgcggctcaactttgccgaacgttaataccaggggatcgccatgctgtttggctttttcaatggactgactgcaaatacgactgaaggcgtgcaccgtatcgcgacgatagcccattggcgttgtgcctgcatggttggactcgccgttgagcgtcaccgtgtagcgacgttgcccgacgatggcgttgacgacgccaatcgactgtccgttgctctccagaacgcagccttgctcaatatgcaattcaacaaaggcgcggatatcggttcgcgcagcgagcggcgcggcgggaagggtaaatccgcacgcctgcatagcgtcgacaaagcctgtgcctttggcgtcctggatatggcgtacctcttcaggattcgccaggccaaaaatgttcttgctgccccaaaaaacgtaagggaaacggctgccttcttcctcagccattgacactacctcgacggtgcgcagcggcgcgccgtaggtcgcttttagccagtcgagcgccagccaggcggcaagcgcgccgaattgcccgtccagattgccgccgttgacgaccgtatcaatatgcgaaccgcttaaaatcacctgctccggaaattgtgtgccgcaaaggcggccatataaatttccgacgtcatcaaagcgtgtctccagaccgctttctgccattcgctttttaaactgctgctgtgtttccagccactcaggcgaataaagtaaacgcgtcattccgcctgtaggatcggctccaatggaagagagccagggcaatgtttcttctatcgcgtggcgaaaatgctttatcatagaaaattcctgtttcaataattattgggcaaagggattttttgtttcgtatgacttgagatagagggcatcggaaatcagatattgataaatatcatcaacaatatcgataccattcatatcggcatttttctgtttaatatcctgatcctgtccaggataataaacctgtttaaaaccgggggcgggcttcacggcattgagttcctgcatggtctgactaatatgtttgcggaataattcacaggaagaaaagaacgccggattaatgaccagatgaagttgtcctaaattgcgtccggcgtgtaaatcttcatacatcgaactgacctggcggccaaacggcagccccagcagaataccggacagaatatcgatcatcatcatcaggccgtaacctttcgggcctgcggcgggtaataacgcattgacggcaaaaggatcatgtgtcggcgcgccatttttatcaacggcccaactctccggaatggactcattgcgggaccgtgcatcgaggacttttccccaggcctgcacggtggtggccatatcaaaggtaatgatgtcatcgccttcgcccggcgcggcaaaggccagcggattagtgccatagtaaatatccgccccgccaaacggcacgaccataggatcggactgacagatagacagaccaatcaggccttcgcgagcagcctggcggacgaaataagagatggcgccgctatggcccattctgctaatgccgacaaccgcgacgccattttttttggctatttcaatagcatgctccattcccattttggctgcgacctgtccggcagcattatcggcatgcagtatcgccgtacagggaccggtattctcaatgcggaacgtcggctcccggttggtgccgccttttgaaattcgttcggcataatattcaacgcgtacggcgccatgtgagtgaatacctctggcatctgcataaaccagtacgtcggcgacgatggcggcgtgctcacgttttagtccggctttataaagcttattttcgataagctgatggagtgtttcccgactgattttcatctgtcttcctttttaacgacggtgtgaagcatgactgcgattaacataccgggaaaataaaatgattatgtgatccagacaggcaaaaaaatataattagaatttatttgataatcaggcgggttttatctttttgcttaaataaaaagcttttttagaaaatcataactaatcctttagccgttgtttgaattcttttgttaataaatttgatgtgacgttaatcactctatttaccctcccggatatataccgtgaagcgcacattaacactgctcgtgcaattgcaatgggtgcaattgcaatgggtgcaattattaaggagttgttatgatccacgcctttattaaaaaagggtgttttcaggactctgtcagcttaatgattatttctcgaaagctgagtgagtccgaaaatgttgatgatgtatcggtaatgatgggaacgcctgcgaataagtcgctgctggaaactaccggtttctggcatgacgattttcatggcgctacgcccaatgacatttgcgtggcgattcgtaccgaagcggtagatgacggcattacgcaagtgattgtgcaacagctcgaagaagcattgcagcagttggcgcagggaagcagcggcagccagtcgttaatccaggtcagacgctgggaaagcgcctgtcagaaactgccagaggcgagtctggcgctggtatcggtggccggcgaatatgcggcggaactggcagagcaggcgctggatcgttcgttgaacgtgatgatcttctccgataatgtcacgctggacgatgaaatcagactaaaacgccgggcgcgtgataaaggactgctggtcatggggccggattgcggcaccgctatgatcgccaatacgccgctggctttcgctaacgtcatgccagagggcaacatcggggtgattggcgcttccggcaccggtattcaggagctctgttcacagattgcgctggcgggggaagggattacccatgccatcgggcttggcggacgcgatttgagcgccgaagtcggcgggatcagcgcgctaacggcactggagatactcagcgcggatgaaaagagccaggtgctggcctttgtctccaaaccgcctgccgatgcggttcgtcagcatattatcgcggcgatgaaagccgccgggaaacccgttgtagcgctgttcttagggttttcctcccccgttgcgcgtgaggaaaacgtctggtttgcctcgacgctggatgaagccgcccgactggcatgtttattgtctcgcgtgacgtcgcagcgtaaagaaatggtttcaacaggcggcgtgattcgtggtctctataccggcggaacgctggcggcggaagcggcggggctgctggccggctatctgggcgtcgcggcggatacggaacatcaccatggcatgatgcttgacgctgacggccaccagattatcgatctgggcgatgacttttataccgttgggcgaccacatccgatgattgacccggcgttacgtaatcagcttatcgccgggcttggcgcacagccgcaggtacgcgtgttattagtggacgtcgttattggttttggcgcgaccgccgatcccgccgcatcgctgattcaggcctggcagaaggcatgcgacgcacgcgccagagaccagccgctgttcgccatcgcaaccgtcaccggaacggaacgcgatcctcagtgccgctcgcaacaaatcgccgcgctcgaagatgccggcatcacggtagtggattcccttcccgaagccactctgttggccgcggaactgattcgacccactctctcttctactcatccatcagccccccggttactggaagcggtggcggtgattaatgccgggttacgtagcttcgcgctggatttacaggctgccggtatgcccgtggtgcactaccagtgggcgcctgtcgctggcggtaataaaaaactggctcgtctgttagaacgtttgcaataaggggttcccatgtttacatcagtggcgcaagccaacgctgcagtcatcgaacaaattcgtcgcgcacgtccgcactggctggatgtgaagccagcttcttcattaattagcgtgctcaatcaagggaaaacgcttcttcatgccggcccgccgatgcgctggcaagagatgaccggcccgatgaaaggcgcctgtatcggcgcatgcctgtttgaaggatgggccaaagatgaaatgagcgcgctcgcgctgttagagcagggaaaggtcaactttattccctgccatcacgttaacgccgtggggccgatgggcggtattacgtcagccagtatgccgatgctggtcgtggaaaatatcaccgacggcaatcgcgcgtactgcaatctcaacgaagggatcggcaaagtgatgcgtttcggcgcctatggcgaggatgttcagcaacgtttgcgctggatgcgcgatgtgctgatgccggtattaagcgcggcgctgggacgtctggagcgggggctcgacctgaccgcaatgatggcgcagggcattacgatgggagatgaattccaccagcgcaatatcgcctcttccgcattgctgatgcgcacgttggcgccgcatatcgcccgtctggaacacgataagcagcagatagcggaagtgatggattttctgagcgtcaccgatcaattcttccttaatctggcgatggcctactgtaaagccgccatggacgcgggcgcgcagattcgcgccggcagtattgtgacggcgatgacccgcaatggcgatatgtttggcattcgggttagcggtctgggcgaccgttggttcaccgcgcctgttaatacgccacaggggctattttttaccggtttttcgcaggatcaggccaacccggacatgggcgacagcgccattactgaaacgtttggtattggcggcgctgcgatgattgccgcgcctggcgtaacgcgttttgttggtgccgggggaatggaagcggcgaaatctgtttctgaagagatggctgaaatttatctcgaacgcaacatgcagctacaaatccccggctgggattttcagggggcctgtctgggactggatatccgccgcgtggtcgagaccggaattacgccgctgattaacacgggtatcgcgcataaagaggcggggattggccagattggcgcgggaaccgtccgtgcgccgctggcctgtttcgagcaggcgctggaagcgctggcggaaagcatgggcgtaagttaagagagcgtctcatgaaacgtatccatcctcttatggcaagccgacaatcggcggattatcggcaaccctggcagatgtcaggggtatggcgtcgctctattaattttgtggcgaaaagcggtgagttattaacgcttcaccgtcgggggagcggcttcagtccgggagggtggatactgcgcggcggcgattttgacgccttgcgcgatgtgctcaccgatggcgaaaaaccgcagtcaaccgctgccggtattcagattggcgagtttcttttatgcgagccggagaggcgctgttcgctgcgggttccacgctatcttgcgtcgccgcgtcttaacgcgacgtacatgcagcgtagtgaggagacggggctgtttgggccgttaaccgtcgccgcagctcagcctctatgtccggaacttcgccagttttgtcactgctttcagtcggcgcttgcaggtgctgcgactgactggcggctatggctgggtaaagggccgggcttaacgcccagtcatgacgacacgctgacgggaatgttgctggcggcctggtattttggcgccatagatgaacgcgccgggcgtaatttttttgcccaatccggcagccttgatcgggcgacgacgctcgtgagcgtcagctatttacgctatgcggctatggggtatttcgcgtcgcctttactccactttattcatgcgctgcgacgagatgctcgcacagaaacggcgattgacggactgctggcgctggggcacacctctggtgcggatacgctgctggggttctggcttggacaacaaatagtaaaaggatagggaatgaaaacgttggtagttgctcttggcggcaacgcattattgcagcgcggagaagcgctaacggcagagaatcaatatcgcaatattgccgacgcagtgcctgcgctggcgcgacttgcccgctcgtatcggctggcgatagtacatggcaacggcccccaggtcggcctgttggctttacagaaccttgcctggaaagccgttgagccttatccgctggatgtgctggtggcggagagtcagggcatgatcggctatatgctggcgcaacgtctggcgcttgaacccgatatgccgccggtgactgcggtattaacgcgaataaaggtatcggcggacgatcctgcttttcttgaaccggaaaagtttatcggtcccgtttattcgccagaagagcaaatggcgctggaagcgacttatggctggcatatgaaacgtgatggaaaatatctgcgccgtgtcgtcgcttccccggcgccgcgtcagattatcgaaagcgccgctattgagttattgctaaaagagggccatgtggtgatttgcagcggcggtggcggggtacctgttgccggcgaaggcgaaggggtcgaggcggtgatagataaagacctggcggcggcattgctggcggagcagatagcggccgatggtctgatcattttgacggatgcggatgcggtgtatgaacattgggggacgccgcagcagcgcgctattcgtcaggcttcgcccgatgagctggcgccgtttgccaaagccgatggcgcgatgggaccgaaggtgaccgcggtaagcgggtatgtgaagcggtgcggaaagccggcatggattggcgcgctgtcgcgtattgatgataccctggcgggcagggcgggaacctgcatctgtctgtgatcgcgacgggcggcaacagagaatgcgccgcccacgctgtttatttaagcttactttgcgcccagataatgccgctggcgtattcgcctggcaggagcggagagagcgcttccagggtggcgctaagacgtgacgtatcgctgtcggtcagattcagatggccgacttttcgccccggacgtaccgctttatcataccagtgcagatgtaccagcggcagcttcagccagtcgtaattcagctcgctgccgatcaggttgatcatcaccgacggggcgttaatcaccggcgcgggcaacggcaggccggtaatcgcgcgcaaatgcaattcaaactgactgatgctggcgccattttgcgtccagtgtccgctgttatgcacgcgcggcgccagttcattgattaacaggccttccggcgtgataaaacattccatcgccattacgccgacgtagttcagcgcctgcataattgctgacagcatcgattccgcctgctcctgctgttcggcgttcgcctgtgggaacgcgacgctggtccgcaagatgccgtcctgatgcaaattgtgcgttagcgggtaaaacacggtactgccgtcatgagcgcgcgcgccgactaacgacacttcgccggaaaaatggataccgcgctcaacaatacattcgccatagcagtcatccggcagttgcccggtttcgtccgcgcgtagacgccactgcccgcgaccgtcgtagccgccaacgcgacgcttaataatcgccagttcgcccaggcggtcaaagatgccggaccactcgtcggtgctggtcagcagctgccacggcgcggtcgcgagtcccagtttatcgaaaagctgtttttgtgtcagacggtcggcgatgatcggaaatacatcgcgattgacgaaggccgggtggcgcgccagctcgcgggtaagcgcggtttccggccagcgctcaatctctgcggtaatgacgctctgctgtaccggcacggcggtaggctctgcatccagaccaaccggccagacggcgatacccagcggttcgcccgcctggcgcagcattcggcccagttgtccgttgccgagaacgcaaacttgcttcatagcgtcccccgcggatcgggattttccagaacttcatcggtttgcgctttgcgccagtcggcaatgcgctgatgcagttccgcgtcgtgttgcgccagaatctgcgcggcgagcagggcggcgttagcggcaccggctttaccgatcgccagcgtacccaccggaatgccgcgcggcatctgcacgatggagtagaggctatccacgccgcttagcgcagcgctttgtaccggcacgccgagtaccgggaccagcgtttttgccgcaatcattcccggcaggtgcgccgcgccgcccgcgccggcaataatcacttgatatccgttctcttccgccgtttcggcgaagctgaacagtttatcgggggtgcgatgagcggaaaccacttctacatggtgcgggacatccagaatttcaaaaatttcggcggcgaattgcatggtagcccagtcgcttttggaccccatcacgatggcgacacgcgccggattattgcgggaagacatgcgtcttaaaactcctgtggtgcgggacacgctgcttttgaggtgtcagagaatagcatgataatcaggcaaggaaaacggttgcgtgcgcgccgtaacggacgattcgacgaacatttacagggggaaggcgattaactcaacgttgtccggcgtgacttttaccattgaaccttcatgatgccatgcgcctaacaccacgcggaatgcgggctggtcgttggcggaaagttcatgcaccgccgggcggtgggtgtgaccgtgaatcagccactgtacgcggtgtttttccatttcggcgacgacggtctgcgcattgacgtccataatatccagcgatttgctgctgttggcggctttactgccggcgcgcattctggcggcgatacggcggcggataaacagcggcagggtaaggaacagtcgttgcacccacggattatggactttggcgcgaaacgcctgatatccggcatcatcggtacagagcgtatcgccgtgcataatcaacacattgcggccatacaggtcgagcactttttcctgcggcagtagaatcatgccgctttcgcgggcaaagcgtttgccaatcaggaagtcgcgattaccatgaataaagaagcaggggacgccggaatcaaccagcgatttaatggcaacggccatttcacgatgtagcgggttggggtcgtcgtcgccaatccaggcctcgaagagatcgccaagaatatacagcgcgtcggcctgacgggcttctacggctaaaaaacgcagaaaaccggcgacgatcgccggttcttccgtttgcagatgcaagtctgcaataaacagtgtcgccacgattactcgctgacggtcacgttttcaatgatgacgtcttcttttggtacgtcctggtgcataccgctacggccagtggcgacgcctttgattttatctaccacgtccataccttctacgacttccgcaaagacgcagtagccccagccctgcagactttcgccggagaagttcaggaagtcgttgtctgccacgttgatgaagaattgcgcggtagccgagtgtggtgcctgagtacgcgccatcgccagcgtaccacgggtatttttcagaccattgttggcttcgtttttgatcgcctctttggtggctttctgtttcatgcccggctcaaagccgccgccctgaatcataaaaccgttaatcacacggtggaaaatggtgttgttgtaaaaaccttcgcggcagtagtccaggaagtttttaactgtttcaggcgctttatcatcaaaggttttgattacgatatcgccgtgattagtgtggaaagtaaccatttttgcatcctgttccaagagagtggtgctttagcccgcaatggggcacatataggggcttgttatagcataaccgtaagctgcgatcaccttgcaaagtgtgctgcttcgattacgaataatatgtatcatacggagattattacccacacacgtctatacggaatcttcgatgttaaaaatttttaatacactgacacgccaaaaagaggaattcaaacccattcatgccggggaagtcggcatgtacgtgtgtggtatcaccgtttacgatctctgccacattggccacggacgcacgtttgtcgcttttgacgttgtcgcgcgctatttgcgttttctcggttataagctgaagtatgtgcgtaacattaccgatatcgacgataaaattattaaacgcgccaatgaaaacggcgaaagttttgtcgcgctggtcgacagaatgattgcggaaatgcatcaggacttcgatgcgctgaatattctgcgtccggacagcgagccgcgtgcgacgcaccatattcaggaaattatcgagctcacccgaaccttaatcgagaaagggcacgcctatgtggcggataacggcgatgtgatgttcgatgtaccgaccgatccgacttatgggcagctttcccgtcaggatcttgagcagcttcaggcgggcgcgcgcgtagatgtcgttgacgtgaagcgtaacccgatggacttcgtgctgtggaaaatgtcgaaagagggcgagccgagctggccgtcgccgtggggcgaagggcgtccgggctggcacattgaatgttcggcgatgaactgcaagcagttgggcaaccattttgatattcacggcggcggttccgatctgatgttcccgcaccatgaaaacgagattgcccagtctacctgcgcgcatgacggcgaatacgtcaactactggatgcactccggtatggtgatggtggatcgcgagaagatgtccaaatcgctgggcaacttctttaccgtgcgcgacgtgctgaaatactacgatgcggaaaccgtgcgctacttcctgatgtccgggcattaccgtagccaactgaactacagcgaagagaacctcaagcaggcgcgcgcctcgctggagcggctatacactgcattgcgtggaacggataaatcagcggccccggcgggcggcgaggcgtttgaagcgcgtttcgtggaggcgatgaatgacgatttcaataccccggaagcctactccgtcctgtttgatatggcgcgtgaagtcaaccgtctgaagggcgaagatatgaccgccgcgaatgcgatggcgtctcatctgcggaagatttccggcgtgctgggactgctggagcaggagccggatgttttcctgcaaagcggcgcgcaggcggatgacggtgaagttgcggaaattgaagccttgattcaacagcgtctggatgcccgtaaagcgaaagactgggcggcggcggacgcggcgcgcgatcgtctcgctgaaatgggtattattctggaagatggcccgcagggcaccacctggcgacgtaagtaagcgcttttacaggccgctctatttgcatagaacggcctgttttttattttttcgcaccgggcgaaagataaacacacaccgactcccccagattctgatgttcacacccgggtattgcccggctgtaatgggcaataaagcggatgacgctgtcgccgctgtttagccccacatttccttttcgcagcaattctgctggctgatcgtcggtgaaaacgttaggggtgaacagttttgcgcctaatcgttcaaaagtgccagcactaacgatagagggttgataaccctgaagctgcaaccagcggcgggcatcattacgtgaccaaacctgcgcatcgtttgctcgcgcaaacacttcgagaagccagccattcgaattctgataagggccggaaaaaggccacgcaattaggttatagcggggactgtggaagagattgagtttgatagcgctatgtaagagcgtttgtaatgccgtcgcgatatctgaacgcgggcgcaaaacggcaatgctctgattcaccaggtcatcagccagaaactcatacagaccttgtatatagagcgctgattcagcggttccgcaagtattcagattatggtaaacccgccagtctccgtttggctggcgcatggcatagccagcatgtgaccaggttaaatgtcggctcgacatatcttgcccctggcgaaccagaatgacgaccggatcgggttgactgttaagctgttgtttgagctgtagcgcctgatccattgtcgctgcgatgctctccggcgtgtttgctttttggtgacagttagcactgtctgcataagcgttgagcgagattgcgctgagccacagggcaaacgcgaaccgcttcatttggccggtaccgtctggttgctggaaagtcctgcgtcgtcctgatttaccatatgggcaaggactttgccctcttttttcaaataagcgccggtgccttcctgcgttttttccagagtgactttatcacctgctttgaggttgccttctttgacgacatgtagcggaacttgcattttaatgtctttgttatcgggggacttagtggttaacagcgcggttttttgctttttattttcgacaacagatccaatgctcaggttgagcggcagcagtacgggggagagtataattccgctaaccagtgcggaactgcccacgctgacaaccgcagacgatgccgcataccagccagtggcagacatttcttcgctatagctggcgtgggaaaatgagaaacagatgaccgcggcggcgaatgtcattttattcatattgattccttttaatatgcgttttaagtacccatagaaataacactaaaatacttcccggcaaccacacccacagcaattctgagagaatgacctggtgtccatacggcgtgatgtagcttgaaagcgcgaacggcgcgactttaatcacctgccagggcgcaaaaaaacgttcatctgaccacggccacagccagccaacgcctttcccacccgtggttatcgaatccagcaggctgtgcgacaacaatgaaacggttaaaaacagccagcagcgcacctgcccagctcgaaaccatcgtcgtcccgcgagtacgcacaacagggggaggacgaatgcgaaaagtaaagagtgggtaaatccgcgatggccaaatacgttgccgtaggcgacgccaaatttaaaggccagcacgtcggcatcggggagcatcgccagcacaacaccggcaaacagcaggcgaggagggataactttcaggcctaagcctgcgccaaaacacaggggaacggcggcgtgggtgataacggtaggcatagcgatcgttcacagggaaatagccatgctagcagttggaacgcagaggattaagtggatgattatctgaaaagacagcgtaatcaggccggataagacgctttgcgtcgctatccggcactctgtatcaggccacgacgttcacactttggccttcaaagctaacggtttgcccggcgacaattttgcagcgtttacgcgtttcaaccgcgccatcaaccttcaccaacccgtcggcaatggcgattttcgcctgcgcgccgctttcgctccagccttccagcttgagcagatcgcacagctcgacgtgcgggtgcttgcctaaagagaatgtcgccatattattttccttgtggatcgtgatattcaatgcacgcctgcagcgtgttttcgataagcgtggcgaccgtcatcgggccgacgccgcccggtactggcgtgatgtatgacgcgcgcgccgcggcttcgtcaaacacgacgtcgccaacgaccttgccattttccagacggttaataccgacatcaatcacaattgcgccttctttaatccattcgccgggaataaagcccggtttacctacggcgacaatgagcaaatcagcatgctcgacatggtgacgcagatctttggtaaagcggtgcgtaacggtagtcgtacagccagccagcaacagctccatgctcattgggcgtccaacgatattggacgcgccaatgaccaccgcattcaggccgtaggtatcaatattgtaacgctcaagcagcgtcacaataccgcggggcgtacagggacgcaggcgtggcgcacgctgacacagacgaccgacattataaggatggaaaccgtctacgtctttatctggcgcgatacgctccagcactttaacgttgtcgatacctgccggtaaaggcaactgcaccagaataccgtcaatcgtgttatctgcattcagagtatcgataagcgccagcagttcggcttcgctggtggtttctggcaggtcataggagcgggagacgaaccccacttcgtcgcacgctttacgtttgcttgcgacataaatctgtgaggccggattgctgccgaccaacaccacagccaggccgggagcgcgaagacctgctgcgacgcgtgcctgaactttttgagcaacctcagatcgcacctgctgcgcaatcgttttaccgtcaataatctttgctgccatcagagagaagattccatctgttacttcaagtcaaaggggatgacgctattttgtcagaagcgggcctcgctgtcagttaacgtttgtgtttccgatgcaaacgcgacgtctcccccgtctgttgacgatactgagacgtggcccgtaagcgcgccatgattaaccaaaaagaaacaattcatcaccctggctatggttaccgtaatccctcgtcgttaatagcatcgggcggcataatgcgacattttatacaaaataagattagacccttcttatatcccaataagaattagcttaggtcattaaaagagtttgcggctattttttatttagcgaaatgtttaatttattaccgtgacgaaatgtcatattcgcaaagattaattactgcgtctgatactcaggggagaaacagaaaactaattaatctgcgatatctatctttacaggatgcagagataacttttctgacatgctatgtcgataataattcaaacggagccgacaggatgccgaaaccgggtgtgtgtaattcaagggaaatccatgaaacataaattaatgacctctactattgcgagtctgatgtttgtcgctggcgcagcggttgcggctgatcctactccggtgagcgtgagtggcggtactattcatttcgaaggtaaactggttaatgcagcctgtgccgtcagcactaaatccgccgatcaaacggtgacgctgggtcaataccgtaccgccagctttacggcgattggtaatacgactgcgcaggtgcctttctccatcgtcctgaatgactgcgatccgaaagtggcggccaacgctgccgtggctttctctggtcaggcagataacaccaaccctaatttgctggctgtctcctctgcggacaatagcactaccgcaaccggcgtcgggattgagattcttgataatacctcttcaccgttgaagccggacggcgcgaccttctcggcgaagcagtcgctggttgaaggcaccaatacgctgcgttttaccgcacgctataaggcaaccgccgccgccacgacgccaggccaggctaatgccgacgccacctttatcatgaaatacgaataatcccgtcagggaacgccagggaagggaggcgcctcaacggaagaggctatcggggataaatagagaacatagcagatgataaggaaaggcgcggcgctagcggggcttgttttgatgtcgcccgtcattgcgcagccggtaatggtggagagcgggcgtgttcacctgcgcggacaactggtcaatggcggctgcgctgtcgccacagaaagccagaatttgcgcgtattgatgggacagtaccgcacgaatgcgtttaccggtcctggcagcttcgctcccgtcagcgttccattttcgttacggttaatctcctgtagcgcggaggtctggcgtcatgtcggcattgcgtttgccggcgttacgcctgcggaagatccccatgtttttctggccagcggcgagggtatcggtaatgccggaatcggcctggcattatttgatgaccagcagcggcaaatcatacctaacacgttaccgcttcattacacgcccattttaacgtcagaaatgactttgcattttactgcccgctatcgggcaatttcagaaaatatgacgccgggacgaattcattcagaagtgtggtttacgctggtttacccatgaattttcttgccgacgtgactcaatgcaaaaggtattttttaccatgctgaatagtataaaagtaggctttattgttcttctcacgttatttacttcgctgaacgtacaggcggcgggggggattgcattaggcgccacgcgcgttatttatccctcggcggcgaagcagacttctctggcaatcagtaatagcgatactcaagaacgttacctcgtcaattcatggatcgaaaataacgctgggcagaaagaaaaaacgtttatcgttacgccgcctttattcgtcagcgagcccaaaagtgaaaacacgctgcgtattatctacgccgggcaaccgctacccggggatcgggagtcgttattctggatgaacgtgaaagccatcccgtcggtcgataaaagtcatattgaaggaaaaaacgttctgcaactggcgattctgtcgcgcatcaaactgttcgtgcgtccggcgaatttgccgcagacgccggaagacgcgccgaccttgctgaaattttcccgtgtcggcaaccatctcaagataaccaacccatctgcttattacctcacgctggtcaatatcagcgtgggcgcgaaaaagattgataacgtgatgatcgcgccaaaaagcgacatgcaaattcccttaccgactggcgcgcagggcaacgtgacatttcagtccgtcaatgattacggcgcattgacgtcggcgacaacggccagtctcggttaagcagagagcgtgaagccacacgagaacacgatgaagaagacaacctggtttgcagggcgatttcccggctatgtatcaccgttaagcagcgtggcgctgtcggtgctggcggcgctgtgtccgctgacgagccgcggcgaaagttatttcaaccctgcgtttttgtcggcggataccgcgtccgtggcggatttatctcgctttgaaaaaggtaatcatcagcctcccggtatttaccgggtggatatctggcgtaacgacgaattcgtagcgacgcaggatattcgttttgaggcgggcgccgtgggcaccggcgataaatccggcggcctgatgccttgttttacaccggagtggattaaacggctgggcgtgaataccgcggcgttccctgtctcagataaaggcgtcgataccacgtgtattcaccttcctgagaaaatcccgggcgcggaggtcgcgttcgatttcgcgtcgatgcgcttaaacattagcttgccgcaggcgtcattgctcaacagcgcgcgtggctatatcccgccggaagagtgggatgaagggatacccgccgcactcattaattacagttttaccggtagccgcggaacagacagcgatagctattttttgagtctgctgagtggcttgaactatggcccctggcggttgcgtaataacggagcctggaactattcgaaaggggacggctatcattcgcaacgctggaacaacattggcacctgggtacagcgcgccatcattccgctaaaaagcgaactggtcatgggggacagcaataccgggaacgatgttttcgacagcgtcggctttcgcggagcgcggctgtactcttctgacaatatgtatcccgatagcctgcagggctacgcccccacggttagaggaatcgcccggacggcggcaaagctgacgatacgacagaacgggtatgttatctaccaaagctatgtgtcgccgggcgcgtttgcgattaccgatcttaatcctacctcttccagcggcgaccttgaggtgacggtagatgaaaaagacggtagccaacaacgttacacggtgccttactctaccgttccgctattgcagcgtgagggcagggtgaagtatgacctggtggccggggattttcgcagcggcaatagtcagcagtcttcgccattctttttccagggaacggtgattgccggcctgcctgcggggctgacggcttacggcggtacgcaacttgccgatcgttaccgtgccgtggtggtcggggcggggcgaaatttgggcgactggggagccgtgtcggttgatgtcacacatgcgcgtagccaactggcagatgacagcacccatcaggggcaatcgttgcgttttctgtacgccaaatcgctgaataattacgggactaattttcaattgctgggttaccgctattccacgcgcggattttacaccctggatgatgtggcatatcgcagtatggaagggtacgactacgaatacgatagcgacggacgccgccataaagtgccggtggcgcagagctaccacaatctccgctacagcaaaaaaggccgctttcaggtcaatatttcgcaaaatctgggggattacgggtcactgtatctttccggcagtcaacaaaattactggaatacggcggataccaatacctggtatcaactgggatacgccagtggatggcaaggcataagttattcgctgtcatggtcgtggagcgagtcggtggggagctcaggcgccgaccgcattctggcattcaatatgtccgttccgtttagcgttctgaccggacggcgttatgcgcgcgacactattcttgatcgtacttatgccacgtttaacgccaaccgcaaccgcgacggcgacaatagctggcagaccggcgtgggcggcacacttctggaaggacgtaatctgagctacagcgtgacgcaagggcgtagcagtagcaatggttatagcggcagcgccagcgctagctggcaggcgacgtatggcacgctgggcgtgggatataactacgatcgcgatcagcatgactataactggcaactttccggcggcgtggtcggtcatgcggatggtattacgtttagccaaccgttgggcgataccaatgtcttgattaaagcgccgggagcgaaaggcgtgcgcatcgaaaaccagaccggcgtgaaaacggactggcggggctatgcggtaatgccctacgccacggtatatcgctataaccgcgtcgcgttagataccaacacgatggacaaccataccgatgtcgaaaataacgtcagcagcgtagtgccgacagagggcgcgctggtgcgggccgcttttgatacgcggataggcgtaagggcaatcattaccgcgaggcttggcggacgtccgttaccgtttggcgcgatagtacgagaaaccgccagcggcattaccagtatggtcggcgatgatgggcaaatttatctgagcggcttgccgctaaaaggtgaactgttcatccagtggggagaggggaaaaacgcgcgttgtatcgccccttacgccctggcggaggatagcctgaagcaggcgattacgatagccagcgcaacctgtatccgtccggcgtcataaaaggaaaaatagagatgaaaatatactcagcgctattgctggcggggaccgcgctctttttcacccatcccgcgctggcgacggtttgccgtaattcaaacgggacggcgaccgatatcttttacgacctgtcagatgttttcaccagcggcaataatcagccgggacaggtggtgacgctgccggaaaaatcagcttgggtcggcgtaaacgcgacgtgcccggcggggacaacggtgaattatacctaccgaagctatgtatcagaattaccggtacaaagtaccgaaggaaattttaaatacctcaagttgaatgactaccttctgggcgcgatgagcatcaccgatagtgtcgctggcgtattttatccgccccgtaactatattctcatgggcgtcgactataacgtgtcgcagcaaaagccgtttggcgtgcaggactcaaagctggtttttaaattaaaagtgatacggccttttattaatatggtgacgatccctcgccagacaatgtttaccgtctatgtgacgacctctaccggcgacgcgttgagcacgccggtatataccattagctacagcggcaaagtggaagtgccgcaaaactgtgaagtgaatgccggacaggtcgtggagtttgatttcggcgatatcggcgcgtcgttatttagtcaggcgggggcgggtaatcgtccgcaaggcgtcacgccgcaaacgaaaaccattgctatcaaatgtaccaacgtcgcggcgcaggcctatttatcgatgcggcttgaagccgaaaaggcctcagggcaggcgatggtgtccgataatccggatttaggctttgtggttgctaatagcaacggtacgccgcttacacccaataatttgtcgagtaaaattccgtttcatcttgatgataacgccgccgctcgcgtaggtattcgcgcctggccaatcagcgtgacggggattaaaccggcggaagggccgtttactgcgcgcggctatctacgagtcgattatgattaaggaggcataatgatccttcggcgcgttttcatcgctatcggttgtgttttgttcagcccgctgagtcaggccaactcatctctgggcgaagtgaatattgaactgcgcggtaacgtggtggattttacctgcgccgtggtggcgggcgacagtaacaagtcggttaacctcggcacctggccgacaaaacagcttcacgccgccggtgacgctacgcaaccggtagcctttagcctaaaacttgaaggttgcccgccggggtcggcgtctataacgttttccgggacgccagcgcccggcacggcattactggcgcttgctgatacggcaatggcgcaaaaactggcgattgaaattcgcgatggcgatcaacgtcgattgccacttgaacaggccagcaaggccgtcgatattgacaacaacggcaatgctaccctgaaattctatgcgaactatatcgccttagccgatggcgtgcagcccggacttgctaacgcggatgcgaccttcctgatcaattacaattagtgtccgttattgtggctcccgaacgataattcgccgggagtacatttacaataattcgtgtgatttggcgtaatcgataagctcaacgatagagtgaaggccaagtttagaaaatatattggccttatgcgcgctgatagtcttgttactcaataaaagttgctcggcaatttctttgttagacattccattggccagatagcgcagcacggtaacttcgcggttagatagtggcatatcatggtgcccgcctttgggggtacgggtattactgatgaaattaagcgtctcagatgggaaaaaagaatagccggataaaatcatttttaccgcattataaatatcattgaggtctttgcgtttacttacaaatccgtttgcgcccgctcttattgctcttccggcataaaaagcctctgatttcgacgataaaaaaagtatccgggtatgttcctggatagatttgattcgtttaagtaaggtaaagccgtcggtgcccggtaattcaatatccagaatgacaaggtcaacaggataagtgcgcagatactctatcgctgttcggctatcatccgttttcaggacaacctgaatattgctatttttaccgagtaaaacttcgatcgacattcttacaatagggtgttcgtccataatgataacagatgcaggtttcattgttgtatgcctcagactgttatgcgtccttcgttttataataagcgtcagacaccttaaagattgtgaaatagccagatctacacaccacacagtggagcaataataaagaatgagacctccctgttgactggctattttgcgtaagagtaataaatatgtggaatatccatttcgcaccaacaaaaaagaaatttctgattaagtaaaaacaatatggattatacctggtctgatttctcggaaaagtcttgcgaaatgcgaattatggatagcgggtaggatattctgtgacgttatagaaaatttgttcgtggtggagctattttctttagagttgacattgagtagtttaaactgttgtttttaagtataaaaataatatgaaagactaattgtttagtatttgttatgtaataacagaaagatgttgacgctggagacctcgaaaaacgaggaggaacaggggacgatgtaagaaaaaaatttttatcgcttaccaggacgagttgtaaatattaattttatgtgaaatatttacatttaatggaagtgaaaataagtaatttcttaaaaaatcttattcaccaaaacgttacttcgttaaaaaatgtcgtggaaagtaacgtttagctgctggatcagccgaagaaagctttgcctgtggggaaggttaaggagggtgataagttgtttaagccggtaaactacacgatgataaggtacgctttgctgacgtgctatttcttttaaagaggcgccttgcgctaaagtttcaatcatcaaccagtcagtacggctaaagctttccgataagcgaggtttggaggctgataacaaggcttcgcgtactgaggccagattttgtcgtcgcgacaggacaaaaaaacgcccagccatacggataaactgtgttatagcggaggttttatctgataccagcaggtaaatctggatatcgctttgttgccaactgagcgcgcgtagctggttaagcgcctcaatacaggagacaggtagcgcctccatatctacaatcagttgtctgagcgaccccttttcaatccacaaagaaatgtcatctaatgagcggaatgctgcggtacgttttccggaaaataagtagtgactcaatgaatagccgaggtagttgtcagttgtaattattgcctgagaaatgataccaaccggcaaggcataattgagctgttggttcagtaactcaaggcgatcaaatatctgcggcgttggagagtgataacggcaggcgcagtctttagcatttcttaaacggcggtgtctttccctgcgtggtacgctgcgcatcctgctttttccattgctctaatatatatctggtaatatggctggccataaataaccttgttccatcgttgcaccagcgtaaaaagcaatgcttcgttgctctgatgtttcaatgccttccatcagcattaactgctgaaaaaaaacttcgctatcatgttctgacggaagttgcgtcaggacctcatagccgattaattgcgcagttgagagattaacgattggctcagattttaacaattcgctgttgagatatgaatgacgtgtgggcgaagacgccaggtgtgggggatttatcctttcctttaacaaaataccctgtgccaccaaacactcctccaggcatttatgatgcagccatatattttcgacccctgaatctatcaggatattatgggcatcattgtggcagcgttaaaaaaatgcctgtaggtatcgttacttaattattggtgagatatttcgtaagccttgtaaaaagttaagtgagtttacttactgagtaagaaatgaaggttaactctaatatattttaaaaactgctgctccgttttaacatgtaattttcgcataatgctccggcggagtgactttgtctgctcttcagaaagtgaaagtaaagcggccgtttcgcttaaatgataaccgctggcgatcagttttaacaggtgacgttctgttactgaaaaatgacgagtcgtgcagtagtggcaaatgccagaagggacgctatgtcgaagcgctcgtttatgtaagatcaatatcattttccgggtaatttcttcaacatcatcttcccgataaatatgcggcagcatatacagacatggtctgaacatgagcttttctttatcgcatttattacaaataatcgcccgtagctgatgttgggtatgcataggtatctgataacagccagcgctgaaccaatcatcatccagggccaggaaagcgatatcggcattatctatctcttctggcggcagaaagtcaattttctgctgccattgattcgccagacgcgtcatgatgattttcaacccatgctcaaagtgactgttttgttccttaatagcgatacgcagcataaaaaaatatcctacacggcaggtgaatcatggtgaaatattaaagaaactgattgattttctaaatactggcggccttaattcccactttatgcgtgctgagatgtgtccaggcgatttcctggaacctggcattgcgccagaaaagacgatattcgtacacttagtcagcaaccagaacaaaagccattgactcaggagtgcctgaccgtataattctcgcgtttcgtctacacgaagtcttcacttcacaaggcgcccttagctcagttggatagagcaacggccttctaagccgtgggtcgcaggttcgaatcctgcagggcgcgccacttataaatcaacgtgttacgcttctttatttcctccttattttccatatgggacatatttgggacatcatcaccaaaaatgtcgtctattttcctcgcgtgttccgttaaatgattaggtgcaaggtgagcatatctgtgaatcaccacggataacctggacacttctgagtcgttgatgatataggttttcatattcagccggtggcatctgctcgctcgaaccatgccggcgtctactgttataaaacatttctatgtaatcaaaaatatcgcttctggcttcgtctctcgttccgtagatcttttcctttatccgttcacgcttcagtagctggaaaaagctttctgcaaccgcattgtcatgacagttgccacgacggctcattctgctctccagtccgtgcggtttcaggagcgactgccattcatagcgggtgattacgtcgccacacggccatcagaagcgcattcaggactctatcttttgtcattcatggttgcagtgaccaattgaatctattgcggcttttttttatatgtcccgctcgtcagtaacccgcttcaactctttcgggagtcggcggattccggtctgatcatctgactgctctttatttctttattggtggaggagttcgacccgtacttctttatcctggcgtaaagactgtgggtagtaatatcgagatgtgttgcggcgctggaaacagaatggccacgctcaacgacctgtcttaccgcttcaattttaaactcttcgggataacgtttaccgctcataggcacctctctttaagtcatcttaaatggctctgaggtgtctgttaaacctgtggcgattcacattgaccgcagattgtcaggttcctttacccggtagtgaaaccagtagggggcagtttatccgcactaaaagacggtgttcctgcatctgtggtggagttgaaccggatgggctttgggcacatgcgtatccttgcgtgtattggtcagttgccggagtctggattaatgcactatggctccgttgggttcttttttgggactgatggtgcattgcgacttcttgctaagaaacctgatggggcatttgtgacatacgatatgtaggaatccccgccgcccgttacccattggtggcggggaacattaattatacatgaatgttatttaattatttccgtaatattctcatttgtcctcgcccctgttctaacgtcccatgtcccagatgtaattgattctaattcatttgaatctatgccgttaatcgcccgcccggaaagccatcttccgtctatttggaatgtcttcttgtcgacatctgcatttataatttttccatcctttgttttaaagctaatgaacatcgctgtattctcatcaagagaatcagcaggatttttattaaactcaaatattacaaaggttttaatgcccatttgctgtttatatatccataatgattttatataaacgttgttacatatttttgcgttaatattaagaggcttgaaattaaaggctcgtgaatagtcgaaaaatcctggagcagttattttcaaatcaatcccgtagtatctagacattgcttcactgttaaacgtatcaagacttgggcctgcatgcagtaccggtggaaagtaataatcaggaattatcgcttgatcttgtttgttatgtttcgccctgtctattatttcttccctaatctccgtttgtttgcttattgatttaattgatgagtaatagaggatgtatgatgggatgaaatataaaaaagccattgcatatgtagtaacagataaataaatggaagccttgttaaatttcgtaaatgcagaatgagcaacaaaggaaatcgaaagaatcataaagcagagtgctccattgagagccctgctgggcattgcaggagatgcaaggaacgcaacatttgcagcaattgcacccagcatgaataaaaagcttccaaacataagtttgctgctactattccttgataacactacagagattagtagtattataaatgcaatatagacctgccaatatgcccccattgctgatggcagcctttctgaaaagtgctcaagaaccctccatgcaagtggttgattgtaccagtcttgtattgtagacgcacgggataggtttcccggagccagcaggagaacccccgcgcctattgcagatccgaatacgccaatcagtaaatatttatttctattcattataaagaaatatgctacagaaattaatacaactacaagagatgtattttcatttgagcaacctgcaaatatcgatgatatggcatatacaaagagtattaaattggattttttaccattgcttaaatatatagaaattagtatataaatggcaatgaacatgttggtccataagtaatttgctgacccaacaagccagaagttagtttgaccgagggctggatttgcaacgaagtataagaaaaataagaaaatcatcacatatggggacggtgacgactttgttaatgtagctgggatcattgtccagcacaacaccattaatgttagcgctgctgagtttattgcattgtaaatatgcggggagaaaaactttaatagagatgtgctgatcgtatctgacacaacccttccgctccatcccaaatagtgcatttttacgctagaaagcgaaagctctcttagggcataagtatagtcatcagagttcattggtgtgataaatcctattgaatacaccaacgagaaaactataaggatagcgattaccatttttaatctattgttaaccatttttcttctcattcttaattatgtacttaggccttttttttgtttctatgtaaatcctgccaatatattccccaagaatacctattcctatcaattgaacgccacccagaaaaagtacagaaacaagaagagacgggtagccaggaacattatttccaaatattaatttatcaataatcatccatgcaccgtaaaggaatgacatacctgcaataaacaatccaatgtaagtccatatgcggagcggaaatgttgagaaagaagttattccttccagcgccagattccataatttccagccattgaattttgaatcgccggcaacacgctcagcgcgggcgtattcaactacatcagtcttgccgcccacccatgacagaacgcctttcataaacagattacgttctggcatctgtttaatattttcgacaacctcacgactcattaaccgaaagtcgccaacgttctcttcaattttcggattgctgattttattatgcagcttataaaaccattcagctgtcttacgcttcatgcgcccgtcagttgagcggtctgagcgcttagccagcaccatatccgcgccagcctgccacttctcaatgagatgggggattacttctatcggatcctgtaaatcgacatcaataggaatgaccgcatccccggttgcatggtcgagacccgcgaaaagagcaggttctttaccgaagtttcgcgtaaacgaaagcggaataacgagcggatcagatgcagctattttgttaattattgattcagtcgcatctttgcttccatcgttgatgaaaacaatctcaacttcatacggttttagctcttcaaactcgcgaaccgttttatagaaaataggtatcgtggcttcttcattgaagaccggaacgactaacgagattttcatttcgcatccctaaagacaatgaactttgaataaatgaatccgcatatcaggctgatagctgaaaaggtgacaagagtaaggagtggcggcagggaacatttgtcagccatccagccaacaacggcgctcagtgttcccataaatcccacgtacatcatgtagcgaagcgtggtggtgctggcgttaaaggtgaagcgcgcattggcatagaagctgaacgatacggcgataacaaaaccggaaaagttcgccaacgcctgatgcgtatgcatcccatacacacaaaaagcaaatacgccccaatgaataagcgtgttaagaacaccgatcgatgtgtacttagcgaataacttcaacattatgaaaatcagcggattcggaaaggtctggagtgtagcactacaaattgctttgatcgatataaacgatcaataatgtggtattcaatagtttaaagttattgttatcttattaattgatcgttgttaccgatcaattggggctactgattgctaagtagtttgggacaaaaacgggacacacaaagctttgcatcggcttgcaaggctttgcatgtttttcgaagatggggcgagtgagcgccgtagtaatgggataacttgttgttagctcaggtagttccaggaacatctaagccgtgggtcgcaggttcgaatcctgcacggcgcgccatttaacctctcaaaattacgttaatccgtaagcttctgcggcggcgacgttgcgccatccgcagtacgtgacgctaatatgcaaataactaattgcgtttaatctgtttatggtgctcctcagcctggatctcgtgggagaaagaatgggcattattcatcgattaatggatgaccattgctttttcatagtcgtccatttcagaaaaggatgtcgcattttccacagtagccggggcgctgggtttctgtgtctgagccatttgctgatgcgcgaaggcgtcaccgttattcatcatctcatgtgctgtggcggataattggcgggattccattttctctgcggtgtttacgccagctgaaataaaaaaacgacagctaaaagggatgtaaacttattcatcttatttctccggtgtgggttaataagagaaataataaaacagttgttgggcctggcgcgtgacgggataatgacgattatatcagattattttgctggctagtgatagcgcctttcactatcgctacagttcaacggaggtgtttggggaatgtcaaaataaaacgagtagcgcgtgtatcggaggtgacagaaatttttccccggtgcgcagtgacgatggattttacaattgccaggcctataccgctgccttcccctttacgctggcgggagggatcaacgcgataaaaacgatcgaaaaggagcggcaaatgttccggcgcgattggcgtaccggggttttcaacaataatatgtatctggtcgtccgcttcttttatccgaagagtaatggttttacccggcggcgtatagcgcatcgtattagagagtaaattactgatcgctctgcgcagcatgatgggatcgccggtgattcagcaggcgcggccttcaaagcgcaagctcccaacaccttttcggcagaaaaactcgatgaggcgctttaccacggggcggtgctccgggtgcggccaaaagccatgacggtagcggtgattatcgccggtctgctacctgttttatgggggaccggcgcgggttctgaggtgatgagccgtattaccgcgccattgctgtcgctgttcatcattccggcagcctacaagctgatgtggctgcgcaggcatcgtcgccttgcggcataacgtgtgcaccccgcctgcggcgtcaaactgcaggcgggttcagcgtacgtttatcgtccgagcgcgctgacccgtttgcggtactcgcctggtgtacaaccgaattcacggacaaaagctttgtgaaaagaagattcgctcgcataacctaccgactcggcaatcaccatcaccggcagcacttcacgcgacagggtctgggcggcgatttgcaggcgcagcgttgttaacacggctaagggcgttgtagcggacacgtcgcgaaatagctgggcgaagctcgcccgcgacatgtgtacccgttgcgccagcgtttcgaccgtccagggatgcgccggtgtttccagcatgtgaaggatcacgcggcccagccggggatgcagtaataaattgagcacgcttttcgccgtgccagcctgcgatagccagtcgcgaacggcgagggtaaacagcgtggcgcactgctgactgtataagacatcagcgccaggtaaatggcgttctgactcctgctgtaacagcaaaatggtggcgttaatccagatactggcggggctatgcggcggcggggcaagacataacacttccggcaacgcggtaaggaaataacgtgacgtcgtgtgcagacgtagactaccgcagacgatatgtgtcggtgattcgccagactggcgcaaacggtgggcggagttttgcggcagaatcaccacctttcccggcgtaagcgtcatggcgtcgccggtaggcatttccagttgcgcttcgccctgcgtaacggtatgccagcgaatcaccgatagttcgccagcggcgtgcggcaactgccagtcgccgcctaacgggcaattcttgtcgattgagccctgaggggcgttaagcgtcaatagccgactaagcgcatccatatagactccagaacagatttattttcaaaactagagataaccatttctgtatctgttcactatatttcggactcaatgtcatttctacccttgtttttgctaaccaccaatttagacgataagacaaaaaatggcgcgttgcggataaccctgtcttttttgacgttatttatacttgtcctgacaaacagatggtgatttggcggagaaagaagatgacacagtatcaggcgctcattattggttttggcaaggcaggaaaaacgttggcggcaactctggcgaagacgggatggcgcgtggcgattatcgaacagtccgccagtatgttcggcggaacctgcatcaacattggctgtattccaacgaaaacgctggtgcatgatgcggaacgtgagggcgatttttctgtcgccatgcaacgtaaagcggcggtcgtaaattttttacgcgacaaaaattttcataatcttgccgacctggacaatgtcgatgtgattgagggaagggcggagtttattgataaccataccttacgggtatttcaggcggacggcgagcgggtgttacggggagaaaagatctttattaatactggcgcagagtcggtgatcccggctattacgggcttaacaacgacggcaggggtgttcgatagcaccgggctactcagcctgagccagcgtccggcgcggctggggattttaggcggtggttatattggccttgaatttgcctcaatgttcgccaactttggtacgaaggtcactatctttgaagcagcgccgcaattcctgcctcgtgaagatcgggatatcgcgcaggcaattacccgtattttacaggaaaagggcgtcgagctgattttaaacgccaacgtacaggccgtatcctcaaaggagggcgcggtacaagtagaaacgccggaaggcgcgcatcttgtggatgccctgctggtggcgtcggggcgaaaaccggcgacggctggcttacagttgcagaacgccggcgtggcggtgaacgaacgcggcgggattatcgtggatgattacctgcgtaccacggcggacaatatctgggcgatgggcgacgttaccggtgggttgcagtttacctatatttcactggatgattttcgtattgtacgcgacgggttattgggagatggcaaacgcagtacccgcgatcgccagaatgttccgtattccgtctttatgacgccgccgctctctcgtgtcgggctgacggaagaacaagcgcgggcaagcggcgcaacggtgcaggtggtgacattaccggtggcggcgatccctcgcgcccgtgttatgaacgatactcgtggcgtactaaaagcggtagtggacgtgaatacgcagcgtattgtaggggtgtcattgttatgcgtcgattctcatgaaatgattaatatcgttaaaaccgttatggatgcagatttaccttatacggtgttacgcgaccagatatttacccatcctacaatgagtgagtctttaaacgatctcttctctctcattaagtaaaacataaataatatagccctgttaatcagggcttttttttgcctgtcagaccataaaaatacgccaggacaaatatgctggcgtctgaaagaaaaggctttagtcaggcataacgtattataacaccattgaaataacccacgactggaaatctcgatgttaaaagttaccacacttattgcttcattattggctgcgccgctggcgttttccgcttccgcccagccgctaaccgacgttgaatatatcagcgtttctgcggtgtcagcaacgccgtcaatgcttgaagatgctattgccagactggcgcaaagtaaacaggcgtcgtcatggaaaattacgtcaatgcgtattgataatacgggttacgccactgcgatattatataaataaggagagtctgagatggataaatatcttcgtctgttaagtcagggggatcggctggggttaacattaattcgcctgagtatcgccatcgtttttatctggattggactactaaaatttgtgccctatgaggcagacagtattaccccgtttgtggcgaacagcccgtttatgtcttttttctatgaacatccggaagaatatcgtcagcatctgactcatgagggcgaactaaaaccggaggaacgcgcctggcaaaccgccaataatacgtatgcgttttcggatggtctgggcgtggtggaattgattatcgcggcgctggtactggctaaccctgtcagccgttggttagggctggcgggcggcgtgctggcattcctgacgccatttgtcacgctgtcgtttttaatcaccacgccggaggtctgggttatgccgctgggcgatgcgcattatggttttccgtatttatcgggcgccgggcggctggtattaaaagatacgttaatgctggcaggtgcggtgatgatcatggcggactccgcccgttcgttacttttacagcgacagtagcgaccctcttaccctctttatgccgcgattcgtcgggtggcgcttgcgccatccgacaatgtgttgatgaatgatggactaccctgacagaagttcctgttccacctgttgaacctgcgcctccagcgtattgcgaatttcggttagcgcccgttcctgctcggagaaataggcttccttatccgcaacggaagaggcgagccgccaggcattttccgtttccagttgcgttatctctttcaacagcgcgtcgatttgcgtgcggagctggcgtattttatggcgcagatgttccaggttattgagcctgtcgcttgccatcatcggttccagaccgctttgcaactgtgtcagtaacgcgcgaattgccgccagatcggcattctgccgcgcctgattaagctgtaccatcatctggtgcgctttttcttttaattcatcggcgaccacatccgggtgacacaggcggctggcctgacgccacaaacgttttaattcactgcgttcgtctgccgacaaacgttgatcgcgggcgtagcggaattgcgcttcctgctgctgctcccgatactggtgatagtcctgttccgcattttcctgcgcctggcggaatgcgctgtcgtcctgatgggaaaaatccgcttccagctcgcgaatttccgccagcaacgcggtgattaactccgtctgctgctggattcgctgacggatgcccaccgcttcgcgcgaggcggcattcaatcctgtccactgctgttttagcgttgccagttgatccacggcctgggaaataaattgcaggcaggattgataatccttttcccggcgttttatttcggcttcttgcttacgctgcatactcaccgcgagctgtttacgcaactccagaatacggctcatcaacggcccgagacgcagatgatagaggtcgttgaaatcgtcgaggatttgtacccgcgcatttcgtttgtcaatcagatcgcgaagttgggcttcaagcgctttcagctccagtttactggcggcaatagagggatcttgccacgtcgagagcgcccgttgagcctgtagccaggcggcgatctcttgcatggcgtcactgaatcgacgagcttcaatcgcctgggcaatcgcgctgattacggcatcctgcggctcatttttcaggtagatgagctgctgacggataatctcttcgtcctcaagttcgatggcgcttttgatgatctctaaacgtttgatgatcttattcatgacgttgatgcctggcgtggctcaaaaacggataacagataccaggtctgattcacctttttgaaaatactgaaaaaatactaaatgtattctgtagggtgtcgtacttttcgtccagagttattcacatattttatacccggcgtctgtcacccgtaacgttctatatcggcgcgcactcttttctttttactccccacgacatctttttttacacgataacgttaacgtccggagttgagccttgacaaacgattgcgccttgcggcagcgagagcgaaatgttaaaaggtgcccctcaataaaaacgatacaggggtaggacgtgaaaaacgcgtcaactgcatccggcgccagcgtgtcggatgccgcgtcgaagaatgaaccgacgcttcaacgggggttgcaaaaccgccatattcagctaatcgccctgggcggcgccattggcaccggactgtttctgggcatcggcccggcgattcaaatggcggggccggctgttttgttgggctatggcgttgccgggattatcgcttttctcattatgcgccagttgggtgaaatggtcgtggaagagccggtttccggatcgtttgcccacttcgcctggaaatattgggggccgtttgcgggctttttgtcgggctggaactattgggtcatgtttgtgctggtcgggatggcggagctgaccgcggcgggcatctatatgcagtactggctgcctgacgtaccaacatgggtatgggcggcggcgttttttattatcattaatgccgtgaatctggtgaacgttcgtctgtatggcgaaacggaattctggttcgcgctgattaaagtgctggcgattatcggcatgataggttttggtctgtggctgctgttctccggccacggcggcgaacatgccagcattgataacctctggcgttataacggtttcttcgctaccggttggcatggtttgcttctgtcgctggcggtgattatgttttcttttggcggactggagctgatcggcattactgcggcggaagcgcgcgatccacaaaaaagcattccgaaagcggtgaatcaggtggtataccgtattttgctgttctacatcggttcgctggtggtgttgctggcgctctatccgtgggtagaggtgaaatccaatagcagcccttttgtgatgatcttccataacctggacagtaatgtggtggcttcggcgctgaatttcgttattctggtcgcgtcgctttcggtgtataacagcggcgtttattcgaatagccgaatgctgttcggcctgtccgtacaaggcaatgcgccgaaatttttaacccgcgtcagccatcgcggcgtaccggtgaactcgctgatactttccggagcgattacctcgctggtggtgctgatcaactatctgttgccgcaaaaagcgtttagcctgttgatggcgctggttgtcgcgacgctattgctaaactggataatgatctgtctcgcgcatttacgttttcgcgcggcgatgcgtcgtaaagggcgcgagacgcaatttaaggcgctgttctatcccgccggaaactatttgtgcattgcgtttctggcgctgattctggtgttaatgtgtacgatggacgatatgcgattgtcggcgattttgctgccggtatggattgtattcctgtttatcgcgtttaccgttttgcgccgtaaggctcattaacttttttgcccgatcccatgttcatgcgatcgggcaatccattaatgccgcaatgtccctgacagcgcgcgaatatcgctgccggtcggcgtctgatgaatacgcaagccaaactcttccaccacggcaaaaatatggtcgaaaatatcggcctgaatgctctcatattccagccacacgacggtattggtaaaggcgtagatctctatcggcaaaccatgatcgtcaggcgccagttggcgtaccatcagcgtcatgtctttacggatgcgcggatggtggcgtaaatattcgttcagataggcgcgaaatgtcccgatattggtcatgcggcggtgatttaaggctgattccggcgcatccagttgtttattccattcatcgatttcctgatgacggctggtaaggtacggctttaacagttgcgcggttaacagccgctgtttttcatcatcatccagaaaatggatactggtcgcgtcaatattaatgctgcgtttaatccggcgtccgccggacgcagacatgccgctccagtttttgaatgagtcggaaaccagcgaccaggtgggaatggtggtgatggtattatcccagttgcgtacttttaccgtggttaagccaatatcaatgaccgcgccatctgcgccatatttcggcatttccagccagtcgcccagtttgagcatatcgttggcggaaagctggataccggcaaccaggccaagaatcgggtctttaaagaccagcattaataccgcggccatcgcgcccagcccgctgattaaaattgctggtgactggccaatcagcagtgagatcatcagaatgccgacgataattgcgccgatgagcttaataccctgaaatattccttttagcggtaactgagaggcggcgggccatttttgcgatagattgaaaatcacgtccagcaaggaaaataacgacagcagggcgtaggtcataatccataactgcgcgcaggtcgtcaggatatccgcagcctcactgcctttttgtagccagagcgcggcctgaatattgacaatgatgccttgcagcgtaaaagccagacgatggaataatttattctgggtaataatttgcagccacaggcgggaactggcgctggcacgtttttcgaaagcgcgcagtactatccagtgcaaaataatatgcacgacaactgctgtcagaaaaataataccaaatatcaccaccagcgacgtggtgtgattcatttcaattcccgctaaatcttctacccgggatatcaattcctgcataatctctcctttataaacagcagcctatgatgactgctgaatggcatttatgcaaatcaggacgcctgcgcttcaggcataatcagcaacagacgggtaaaagcgcctctggggttatccatacgctatattttatcctgcgccctgtaaacgtcgttattttacgcggttccctctttttgaacaggcgccagtccgtcaacaatgaatgaaaattttttaaccagaatgtttaaaacgattgcaatatctctgtcggataatgattagcaccgtcgtacctatcaacaataacattaaggaacatcggatgacccaaaagcgtaccctgctaaaatacggcatactctcgctggcgctggccgcgccattatctgcctgtgcgtttgactctcttacggtgattggcgatagccttagcgataccggtaataacggtcgctggacctgggatagtggtcaaaataagctctacgacgaacagttggccgaacgatatgggctggaattaagcccttccagcaatggcggctctaattatgccgccggcggcgcgacggcgaccccggaattaaacccgcaggataataccgcggatcaggtacggcagtggcttgccaaaacggggggaaaagccgaccacaacggtttgtatattcactgggtcggcggaaacgatctggcggcggccatcgcgcaaccaaccatggcacagcaaatagccggtaatagcgccactagcgcggcggcgcaggtagggctgttactggatgccggcgccgggctggtcgtggtgccaaacgtaccggatattagtgcgacgccaatgcttctggaggcggtaatcaccgctgggctgggcgcagcggcgcccccggcgctaaaagcggcgttagatgcgctggcggagggcgctacgcccgatttcgccagtcggcaacaggcgatccgcaaggcgctgctggcggcggctgcaacggtaagcagcaatccatttattcagcaactgctcgttgaacaactgctggcgggctatgaagcggcggcagggcaggcgtcagctctgaccgattattataatcagatggaagagaaggggctggagcaacacggcggcaatatagcccgtgccgatatcaacggcctctttaaggaaattcttgccaacccgcaggcgtttggtctgacaaataccgtaggtatggcctgcccgcctggcgtatccgcttcggcgtgctcctcggcaatgcctggatttaatgcgtcgcaggactatctgtttgccgatcatttacatcccggtccgcaggtccataccattattgcgcaatatattcagtcgatcattgccgcgccggtacaggcgacatacctgaaccaaagcgttcagtcgatggcgcaaggcagtcgtaccacgcttgacagccgttatcagcagcttcgccagggggaaaatcctgttggttcgctgggcatgttcggcggatacagcgggggatatcaacgttatgataataatgaggccgacgggaacggtaatcataataatctgacggttggcgtcgattatcagcttaacgagcaggttctgctgggagggctgatagccggttctctggataagcaacatcctgacgataattatcgttatgatgcccgcggttttcaggccgccgtattcagccatttacgcgccggtcaggcgtggctggatagcgatttacactttctgtccgctaaattcagtaacattcagcgcagtataacgctcggtgcgctaagacgggtggaagagggcgaaaccaacggtcggctgtggggcgcgaggttaaccagcggttatgattttgtcatggtgccgtggttaacgaccggaccgatgctgcaatatgcatgggattacagccacgttaatggttatagcgagaagctcaataccagtacatcaatgcgttttggtgaccaaaacgcccattcgcaggtgggtagcgcgggttggcgtctggatcttcgccacagcatcattcactcctgggcgcagattaattatcgccgtcagtttggcgatgatacgtatgtggcgaacggcggccttaaatcgaccgcgctgacgtttagccgcgacggaaaaacgcaggataaaaactgggttgatatcgcgattggcgcagattttccgctgtcggcaacggtgtccgctttcgccgggctgtcgcaaacggcagggttaagcgatggcaatcaaacccgttataacgttgggtttagcgcccgattttgatgacacgccagggagggccaaccccgttcgttcgtgacacgatgagccgaaagcgcaacggtaagttttataaaaagtaagtattttcaaaaatgtgggtgaagcctgtgacgtcgtttgtaaattatcgtataagcggagtttacgtttttggcggggcgcaggtatgaataaagagtccatatttcgtcagttggagctacggctagccggatgttcactaacagctgacgcgttaggcgcgtttagcgcaatggcgattgccgacagtctcaggcaaaaacgcagcattattagtcaccatcttaataacttgcatcgtgagcagcgggtggtcaaagtgaatagccgcccggtgctgttcctgcccgtcgaggcgctacgtcgtcaccaccggctggcggttcggcagggggattacgcgtccattcaggcgctgtgcgcggagcggcaggacagtctggagctgctcattggcgcacagggcagcttgcaggagtccctgcgtcagtgtaaggcggcgatcagttatcccggcgcgggcttgcctttgctgctgcgcggcccgacggggacaggaaaaagttttttggcgcgtcagctttggcagtacgccatcgagcagggcattttgcccccggaggcgccctttaccgtgtttaactgcgccgaatacgctaataacccggaattgctgacgtcaaaattatttggtcatgccaaaggtgcgtttaccggcgcagacagagcggtatccgggttaattgagaccagtaatggcggcgtattgtttatcgatgaagtgcaccgtcttccgccggaagggcaggaaaaactgttccattttatggataacggcacctggcgtcgcttaggcgaaagcagcgatgaacgcagcgccacggtacgtctgatattcgcctctaccgaagatctggaaaagcactttctggcgacatttattcgccggataccggtcattgtcaaaattctgcctatcgccgaacgcggacagtatgagcggctggcgtttattcaccatttttttcgtcgcgaggcgcagcgtcttcatcacgatttgtcgctggatagtgaaattatcagccaactgatgcaggagaccctggaagggaatgtcggcggcctggaaaatctcattcgtaatatttgcgccagcgcctggactttcggccagcgtgacgatggggtactggaagtaaaagccgggcaactgccggatcgtctgctgatggaggtgccctttaccgttccgcagacggcggaacgcatcatgatttatcgcgaaggtggcgtttttccgcgagtttccggtcagcatcaggaatatttacggttgacggaaaacatttgcggcctgtgcgaagagctggcgcaggagaatatttccgcacggacgtttgacaagctggtctatcaaaaccttacgttatatctcgatgccttaatgaataaagagagccctcgcgctcgtcaggacaagcggctgcgttttatcgaagatgtcgggaaagcgatcgctgcacattacgatctcgaactgaatgcggaattcgcttatctcactggacgttaccttaccagcctgccgttaacgccggtggaggcgtcgccatcggttcgtcatgtgatgctgcgctggctggaggaggcgccggggctggcgcagcgtgtggcgcaaaaactgctggacgtggtaaataataaatatgatttgttaatcgacacgctcgacagactggtcgtggcggccatcgtcagtaatgccattgacgccaccagcggcggtaaggtaaaagcgctgatcatcgcgcatggttattcgaccgccagcagcattgcaggcgtggcgaaccgtctgattggcgaaaagatttatcatgcgatggatatgccgatggaggtcgcgtttagcgatgtcagccgggccattgtcgattatctccagcatacggatacccgcgcaggcgtcatggtgctgatcgatatgggatacaccaaagagatcgccgatgcgcttttgagcgtaattcatggcccgctggtggtggtcgataacgttacgacgcgtctggcgctgaacgtggccagcgagatcgcgctgcaaaaaaacatcgaacagatcgccgaagagatcgtcccgttaaatcagtcgcgctgggatgtcttctggcccgcgcagaaaaaagcgcgcgcgctgctggtgacctgtattaccggcatcgggacggcgtttaaatttaaaaatttgatggaaaaaagtcagttgaccgactttgatattaatattatcgcctgtgaatatactcgcctgaaaaacagccggatggcggcctcgttgctgaatcagtatgaagtgattgcggttgtcggcaccattgacccgcagctggcgggcgttccctgggtggggattgaagagctgcttggcgagcaggggtatgcgcatttaagtcagttattaagcggttatcttaacgataaacaaattgcgttaattaataaaaatatggttcgcgaattttcgttgcataatgtggttaattcgctgaccattctcaatgccaataagacgatagggcatatcgaaacgattattgccgaatggcaaagtacgctgggcttcagctttaataataatttgattattagtttatatgttcatttgagctgtatgattgagcgactggtcatgcgcaatgaaattacccactataaaaacatgacggaatttaacgagcggcatggtgaatttatcgcgatggtaaatcattcatttcagcggttgaaaattctttataacgtggcgctgccggtagcggaaattggctatatccacgatattttcgaattacggatagaggattttcactggtagctgcggtagttcagggaaaaaggggcgctagcgccccgcagaagaaagacctgatggcgctacgcttatcaggcctacagatcgctttgtaggctggataaagcgaagccgccatccggcataactattaatattcaactttccacatataccggcgggtggtcagtgggtgattacgggctgtcgccagagcgaggttataaacgtccagcacacagttgtgcaacagaccgcagaagtattcgccaacgtcggtggacagatcctgaatgccgagtttatccgcatcgatcaactgcagttttccctgatagcgttcaataaagcgaatcgcacgatcgtccagcgggcgagtgcgaccactgctttgcagcaatataaacggcgtgcccggctcggtgatttcgaacggtccgtggaaatactctccgctatgtatgctggcggagttgatccactgcatttccagcagaatacagatagactcctgatgcgcggcgccgaaagaggggccgctgcccatcatatagaccaccttctcatccttccattcggcggcgaaacgctgagcatcttcttgtacctgccgttgggcgccgtgaacaacgtcgctaaagcgcccaaatgcgctgactaactcatcgtattgcgcatagccctctgtttgggcgagaatttccagcgccagccacaggctgtatgcggctttttgttgtgcagggtcgaccgtttccggataacgcgcccactgatattcaatgatgtagtcgctgtattcgcacaacggcgtgtcaggttggtaaaccagaccgatggtcgccgctcctttttcacgcgccacgcgggcggctgcgacggtttccgccgtattgccctgctgcgaggcgagaataacgacgctattttttcctaatgcttttggtgtggcgtggacaaattcattactggtgatataaccgacagccagttttgacgcttcacagtccagaaagtattttcctggccagaagccggttaatgaaccgccgcagccgacaaaccagacgcgttcaatgttttgtttacctaaaatatcgctaataatacggcgggcattttcatgagcaacagacatatttatctccttagcgtgtagcgcgtcctccgcaacagcgcggataataacgagcattaataaaaattaaatttcttgcttacttttcattttttgatggaattgcggatctttgggtatcgccggattaatgcctttttgcgggggtaatatcgcacatagcatttgtagcggaatgatatattcaaagacggcaaagtcctcatcattgacaaacgggaaattcagattcagaccattattttctacctgcgggccgatgcggtaaatagacggcgtccactcaccgagtatttgcgccagccgatcctgacgcgcgtcaggctgcgggtcgagcataatgagtgcggattgcgcattaaaggcattgtaaataccgtgaataaactcctcgaattcgtagcccgacaccggacagcgcaacgtctccagcatcttgagcgcaccctcctgcaccgtaccgaacagcgttgccgggccggtcagacgaatatctgcgctatcgcgcagcgccagcgcattggtttgcgcccacgcctgcgaggcggtaaccagcgcgggcaggtggttaaaggtcttttccatccgcagcagcagtgaccggcgctgttcgccgtccagccgctgttgctgcccggcgacggcgagcgccagcagcatcaaattgagaaccgtgcagtgatagccttttgttttcgcgccagcggtttcttcgccgcagggaacggtaaggatataatccgccgcccggtcgatagtcgcaggcgccacgccagccattgaggcggtgatatgaccaacattgcgggcgcgctccatcgccgccagcgttgagaggctgccgccgccctgggagatgccgacaaccagcgccttgccgctgcgggcaagcgtctcgtcgtcaagcataaacggccagcagacatccactggtaatgcgcaccagcgctgcataaacgtgcgagcggtcagcgcgccgtggtatgacgtgccggagcctgtcagaataatgcgggtgacgccgcgttccgttagcgcctgcgccgcgcgccagagatcttcccgcgtctgcgtcagcatctccagcaggcgaaggggcgtctcgttcatatagtcttctacttgcatagtgttacctctcgtcaaagcaggcccagcgcgctggcaagaagcccaaacacgacggtgcctaacaggatccagttaatgttcacgcccttacggataagtttgtacatgccgagcgtgaagagcagcggcagcagggaagggaggattttgtcaataaaatcctgcactttcatggtagtctgcccggcggtaaagctcagcggggttgtaatgtcgatcatgctggcggtcatggcgccgacgaccatcaacccgacgattgacgcgatataagtcaccctgtccatcagcccgctttgccagaggcgcatcagccaggtggtccccgcccggtagcccagtttgagggcgtaccagcggcagaggatgtgcggaatgttatagaccagtagggcgagaatcggccccagaatgctgccctgctgggcaaagtagatccccatcccggcggcgataactttcagcgatccccagaagatggaatcgccgatcccggccagcggccccatcaggctggttttaacggcattgatcgactcttcgttaaagtccgggttgcgttgattttcctcctccatcgcaatcgacaggccaaagacaaacgttgacagatgcggcgtggtattgaacagcaccagatgacgctgtaaggcgcgccccagttcggcggggtcctggtagatacgctttagcgctggcgacatagcgaaggcatagcccatatgctgctggcgttcatagttccacgatccttgcaacgtaaaggagcgccagaaaacgctgcgtaaatcgcgggcggtgatgcggctttcgctttgcgagtgagcctgtgcgtcgtcgatcagggtctgcgtcacttcactcatgattagccctcctgttgggatgtgttaagaaactggctgataatgaaagccagcaccacggcaaacagcgcgatggcgatgatgtccagtttggtatatgcggcgatcagaaagcccagcccaaggtaaggcattaatttgctgctaagcatcatgctgatcagcaacgcgaaacccagcgccggcaaaatcttactggcgacaaccaggccattggtaataaaggcgggaatggcgtcgaggaaccaggtgacggcggcagaaccgagcaaaatggcgaaaaagaccggcagaaaaccgcttagaaaatagagcagcgttgggcctcccaggtgcataacggcaaccatccgggtattaccctgcgccgcataacgatcggccatgtggccaaagcgggcgttaaccacgcgcaccaggacgccgagggtctgcgccagcatagagataggaatcgcgatggtcagcgccgcttcgggcccgcgcccggacataatagaaaacgcggtcgccagcaccgaaccggtgacgacatcaggcggtaccgcggcgccgatagcgacattacctaaaaagatcagttccagcgtcgcgccgatcagaatgccttcgtgtaaattgccgcagaccagaccggtgagggcgcacatcaccagcggacggtcaatcatcgacacgccgagtaaacgcccgtcaagaatgcccagtgcggcaatcaggccgagcagcgttgcggtgagcaacatagtgacctccgggttcagagtttatcgttaagcaattcggcggaatgagccggaacctggcgcatttccagacggatgcctttggcttttagcgcctggctatcggcaatctcctgctcggtcaggtatatggctttgccgaactgctgcgcgccctctttttgcgcgataccgccgtagttgataacgctaatccctggcactttctcgacgaaggcgagggtttcggcggtatttcccagcaccaccatcacttttttgtgatccagcttgccgctggcgagtttttccgccgcctgttccaccgtgataatgtccagcgacacgccagcgggttttgccagacttaatgacatagagacaaacgcgtcgccggcggcgttggcgttagcgacgatgatatggtcgatatccagcgcccgggtccaggcgaagaccacctggccgtgcagcaggcggtaatcaatgcgcactaatttgatcatgggattctccctgtaggtcagcggatggttgtgttattagcgtgttgataaagacaatggattcacgcgccgcattggtggcgtaggtaatggccgcgtctgtgctttcttcttcacagagtaaaaactccagcaacagggtcatgttgacgccagccaccacaaaaacgtgacggtgacgcatcagcactttcgcggcgctattgttgatgctgccgccgagcagatcggtaaacaccaccacttcttcgccgttggcttgcgcgatcagattttcgagggtttgttcaagctgctccgtggtgacaatatcgccatcgtaggcgcaaaccggtgtcacgccgtgttcgtcgccaatcagcagcgatagactgttaataagtccgcgggcaaaagggccatggctggctacataaacatgtctcacccgttttctccttcatccagatagggggtatccagatatggcaaacggcgtgccagttttaaatgttatttattttcaataaattgaaagaggaagttaacactagcgatgtaaaacctggcacttcgcgccattgatcattgaggaacctggcagaaaggtgaaaaaagccggacgggcgtccggcttaggcaggggattaaacttccgtcagtgtggtttcaagcggcagacgtgatttcggcagcccggcgttgaaatcctcgacgctatgatggccgaccggcaccacgaccagactggtatagcctttttctttcagaccaaattcagcgtcgagcacctcggcgtcgaaaccttcaatggggacggcgtcgagacccatcgcggcgacgcccagcagaaagttgccgacgttcagataaacctgcttcgccatccactggtggtcatctttcagcgagacgcggtgcatatcggcgaaaaagcggcgacctttatcatttgccgctttagcttccggcgtagcgaaacggccatcagcatcttcctgatcgacgacgcgctcaagccatgcgtcatccattgcggttttggcgcagaagaccaccacatgggaggcgtccagcattttgcgttcgttgaacgtgtagtttccggcagcggattttgctacgcgcgctttgccttcttccgtactggcgacaataaagtgccacggctgggaattggtgctggaggggctgtactgtagtagtgtttttattttatccgcttcttcggcggtcagttttttgctgggatcgaacgccttagtggagtagcgctgtaaggcgacagaaacgatatccataaatgctcctggttggtttagtacccttttgtatcagcagggtaccgggttatcggtaaaaagataagggaggaaaatgcggaaacggttattgcatcagcgcggccgcaggcgcagttgctctcttttaggcagcccgtctacgaccagattccatgagtcatttatcaaatcgttgagtagcgagacggtgatatcctcgcccgcatagactgaaatccagtgtttcttattcatgtgatagccaggcgcaatgctggggtaaatttgttgatttaccagggacttttggggatccgacttcaggttcaccactgggcgacagtgatgttcagtgaacagcatgaatattttgccgccgactttaaacacatcgtactgtgggccgaaaggccagcagtgttcggtaaaaggcagttccagcgcaaagcgttttgcccaggcgtgcagtgtttgaccgtccattattgctcctcgcgagtcagcgcgcgccacatggcttcgaatcccagcgcaatatattcgccagcgcgagcgggatcgcgcgcggcgaaatccattgttgtttcagccagcgccagaaaaaggccgtcgccgaaggcgcggtattcatccgacataaacaccatcaaaacggaacgatgacataaatcgcgcaattcggggaacatatcgtcggcccgttgttccgtctctttggtgagcttttcgctgacggccagttgacggatcgcccgatggcgcgcgggatggttcagaccccaactgatgtaactgttccagataaaacgagtcatcattttggcatcggtaatggatcgatccagctccattatcattgactggcagagatcctgctttaaatgcaaatacaacgtgttaatcagctcatctttggtcgcgaaatagcgaaacaatgttccttctgcaacacctgcgttacgcgcaatcaccgccgttgaggcggcgataccggattgcgctatcgcctgggttgccgcttccagtaatgcttgttttttgtcttcactcttcggacgagccactacacgttacccttatgtctggaaaaacatgattgaatcatgcccgttgtcgcgtcgcaacggtgaatgtcaacctttgaaaagtaccttgacggcgtatctttgctttctataatgagtgcttactcactcataatcaagggctgccgcatgaagtggtagaaaagcatattgcaggccatgcgataagctgtctcacaatttgtgtggttattactatgcttattgctgttgccgtaaatgtgcggtgcgggagccgctgacgagtttgatagaggggagagcacgatgaccatttccgctcaggttatcgacacgattgtcgagtggattgatgataatttgaatcagccgttacgtattgatgatattgcccgtcatgcggggtattccaagtggcacctgcagcgcctttttatgcagtacaaaggggagagtctgggacgctacgtgcgtgaacggaagctaaaactggcggcgcgcgacctgctcgacaccgaccagaaggtgtatgatatttgtctcaagtatggttttgattcgcagcaaacctttacgcgcatttttacccgcacgttcaacctgccgccaggcgcttatcgtaaagaaaagcatggccgtacgcattgaaatgtttaatcggccagcgaaaaccagcgccgccagataaagcgaatgacataatattccagcgcgccgagcaacagaaaccataaacaaaacaacaaagtataaagctggttgagatccataagatgaaagatcccgaccagtttttgcgccagcgcaaggccgagcgaaggggcgggcagcagcaggctggagagcaacgccatcagcaaaataccggcagcggtcatcaatgattcaagcgggtgtttcatggctttgttaaacgtaagttaaaacgccattgtccgggatatcgcctggtaaggcaaatatgctgtctattgtcccgcccagatttcacaatgtttttgtaccagacctatcagcgatccgccgtcggcaataaactcccgcatatattgcgcttcgttaccgccttttttcacctgcagacgtagcgcgtcaatggcgctgtcggcgcccagcttgcgcgcagagggggtaacgttgtccagcagacgcagcgtatcatctgccaggcgacggcggtcgccggtataggcatcggttagcacgccctccagaccatagcggcaagcctgaaaacggttgaatttatataacagatagtcttgttcctgcggtttaaagggacgctcggtcagcagccagtgcgcggtcgcctgaatcaaccctgccatattgatggcatgatcaagagtgagcggcgtatccatcacccgaacttctaccgtgccaaaggccgggctggggcggatatcccagtgcaaatctttgatgctgtcgatcatcgtggtgtaagacagacgacgaaatagtccggcaaactcttgccagttactgacccacggcatgggcccgttatcgggaaaagcggaaaaaatattcaggcgcgcgcaggcaaaacgggtgtcagctccttgcatatagggggacgcggcggagagcgcaataaagtgcggcacaaaatgcgacagcccgtgtaaaagataaatcgcatcgtcgccgttcgcgcagccgacgtggacatgctggccgaaaaccgtcgcctgttgaattaagtagccgaaattttccagcgtgcgttgatagcgctcattatcacagacctcctgacgctgccatttttgaaaagggtgcgtaccgccgccgcaaatgccgagatggtgttccgacgccgcctgtaaaataacgtgctgcatagcagaaagttgggccgccgcctggtcaatatcgcggcagacgcccgtggccatctccagcatactttcggtgatatcgtgcttaatttctcccgcagtaagttggggcttaacggcgtcgatcagcgtagaagagtcctgacttaaatcgtagccaggtggattgatcacctgcatctccagctcaataccaagcgtataaggttcagaaacgtgaaaatcattcagcgccatagggatctcatttatcggggtattgcgctaagtatagaagcgggagcgctcctgtcgtggggaacgcgcgttattgcagaaacaagagtaataacgctattgtcacgttgaaaccattctgtacggacggtacgttcagccatcgtggcggcaaaggctggcagcagatgtaacgagatgtgcgtggcggtaagcgaggtaacttttgcgctattgaatcccgggagcgtgacgcggtctgaaaaggctttataaacgctctctttggcggagaaagccagcgtcagggcaagcggaaaagggagcaagctcgcctggagaatttggcgctcatcgctatcaataatggacggcgccagctctgtcgccgtgtgctgactcatgattttttctatatcaatgccgatacgctgtcgggatatgacggccagcgccgttgtcgcacagtggctgatgctgccaaataggccgtccggccatagcggctgtcgcttgtcgcccataccgggcactgtcctgacgcccacctcgcgtagcgcatgaacggcggcaatgcggcctgccagatgttcagctttacgcttgcgtccggcagaccggagccgatcgtgatgaggtagccatagcaggtcgtgttcgcgaaagctgctcgcatcaaagtcgacgatatgcagcctgtgtccggcaaagggaaggggaaaatgagatgtcagcatcgtttttgccaattccctccccgaatgagggagggaaggttgccatcagaaatgggtattaatgctcatataccacgtacgtcctggttcgttataggtgtacgcgccagcgcccgccatataagcgccagtttgcgtatccctgacggtttgcgcgttaccttcacgccacagacgtttgtcaaagaggttatccacgccaccggtcaggctgacatttttggtcacgtcccaggtcgcgctcaggccaacaatactgtatgggctgaccgcttgcttatctgttccggtaacggggttaccctgataatcatatttcttcggctcttgtttgccgtaccaggtgaaggtcgattgcagagaaacgtcctgacgtacctgccagctcagggttgagttaagcgtgtactgtggaataatcgacaggcgttcgccggtctctttgtttttactctgcagcatatacgtaacgttattcgtccagttgacggtgtcgctaaccggtacgtttaacgtgccttccagaccttcaacgaccgctttcggcacgttctcccactgataaacatccgttttgccgttgttgatacgctgcaacggcactgtacccgcttcaatcttattgcggtaatcattgcggaaccaggtgacgccggccagccagccatcgcgtttaaattccagaccgatctctttattgatgctagtttcggctttcagatcatcgttacccatcatatagcagccgatgccggtacccgcgccagtcgcgtagcaaccctgacctttactgtacaaaatatagtttgggttagtctggtacagactcggggctttataagcgcgggcgattcccattttcagggtaaagtcatcccccagaccttgcgacaggttgagggacgggctccagttatcccccacaatactgtgatgatcgaaacgtagccccggcgtcagcatggtgctgtcggtcagttccatgttgttttcagcaaacagagagaaaatttccgcttttgaataggggctacgattggtactgctgtaacccgggatatttccccccataaaggtttgcgagttggagagctggtctttcatacgctgttgggcccattcagtacccagcgtcaggttttgattgaccagcagatcgaaaggaaggctcacttcgctgtgtagggtgacgtcattcaaatcggcatcggcatatttttgcgatgctttgggatcgaaaattccttcggtgccgcctgccaggccttccggcatccgggagttacgggtatgttcgtattgcacccagttactggtggttacgccattattccagccgccgttccaggtcagagagtagttctgccgatagaggcggttcgtctcttttccgtaattatctttcaccagttggttcgtattggtgttctgagtatcgccggcatagagattgccctggcgactgtatccggcctccagctccagagactgaagcggagcaaaatcccaacgaaccacgccgttgatatctttgttaatgaccccctcgcgtcctgctggtagcgtgtcggcgtaactcccggtacgttcagactgatgcccctggttaatattacgcgcatccgcctgcgttttgtcgaggttgccatacaggcggaagctgaaatccccgcccagcgggccgttcaggctaaagttagtgcgtttggtcgcgccttcgtctttatgttccggcgcgttgaaataggtattccaggaaccgtgccactcgctaccgccttttttggtaatgatattgactacgccacccgccgcgccgttaccgtagcgtgcggcggcagggccacgcagcacttcaatgcgttcgatcatctccggcggcacccacgcggtatcgccgcgggtatcgcgttcgccgcgccagcccaggcgcaccgagttacggctggtgacgggtttaccgtctatcaggatgagggtgttttccggccccatgccgcgaatatcgatttggcggttattcccgcgctgaccgctggtggagttgccggtcaggtttacgcccggcatggtgcggatgatttctgacacgtcgcgcgcgggcggatttttgcggatctcatcggcggtgatggtggatacgcctggcgcctgtaggttttgctgggcagcggtcaccacgatggtgtcttcattggtgagcgcagcgctatcggttttgtcttccgccatcacgggcagagtggccccgtaaatccctaaattgaccagtaaggtcagggaatgaatcttcttgttcattgtatatcctgcttttctttagccacataagccaaagcgcccgtcaaaggcattggccgggtggtgaaattgtgttcgcgcgtcccatagcgcgacaatacgctattgcaaatgcaaatagttatcaataatattatcaatatatttcaccttttatatacaaaattcataataaacacagggttataatgaaagaggcgctggcaacgggaagtgaggcctggtggaggacgaaaaccgggccggaatggatacgggaaaaagacggaaattatcgggtcactttttggtggcgcgacccgcagggaaacgaaacacactccccgatacggcgtgtctgggtctacatcactggcgtaaccgatcatcatcaaaacgcgcagcctcagacgatggcgcgtattgccggaacggatgtctggcgctggagcacggcgcttagcgctaactggcgcggcagctactgttttattcctaccgagcgcgatgacgtttttgccgcttttgcgccgggcgaaacgcccgatcggaacgtgctgcgtgaaggctggcgacagctattaccgcaggcgattgccgacccgcttaattcgcaaagctggcggggaggacgtggtcatgcggtttcagcgctggaaatgccggatgcgccccttcagccgggatgggatcgtcctgaaacgccgtactcgccgcctttgatgatgcagtggcatagcgaacgtctgggtaactcccgccgcgtatggatattgacgaccggagacgaggcgccggaggaaagaccgttggctattctgctggacggtcaattctgggcggaaaatatgcccgtctggcccgcgctcgcctcgctgactcatcaacgcctgcttcccggtgccgtctatctgctgattgacgcgattgatactcaacaccgcagccaggagttgccctgcaatgccgacttctggctggcggtgcagcaggaactgttgccgcaagtcagagccgtgacgccttttagcgatgatgccggacgaacggtggtcgccggacagagctttggcggcctgtcggcgctgtatgccggcctgaactggccgacgcgttttggctgtgtactgagccagtcaggatcgttctggtggccccatcgcatcaccccgccggagggggaagtcattacccggctgaaaaccggcgcattatgcgcgcgcggactgcgtatcgtactggaagccggcgtgcgtgagccgatcgtgtttcaggcgaatcaggcgctttatgcccaactgaatacttcgcagcagtccattttctggcgtcaggttgacggcggacacgatgcgctttgctggcgcggcgggctaacgcaagggctgatgctgctttggcagccgcttatcgacacgctttaaccgggcacatgtccatgacaggagttgagtatggaattcagtaatcccttcgataatccgcagggacagttttacatcctgcaaaatgcgcagcgtcaattcagcctttggccagcggcatgtgcgcttcccgcaggctgggacgtggtatgcgaaccgcaatcgcaggacgcgtgccagcagtggcttaatacgcgctggacaacactgaatccggcgcattatgccgataagcaggaggcgaaatgacgcagcgtttaccgttagtcgccgcccagccggggatctggatggcggaaaaactctctgatttaccctccgcctggagcgtggcgcactatgtggaactgaacggcgagctggatgccgccttgctggcaaaagcggtagcggtagggatgcaacaggcggatacgctacggatgcgttttaccgaagagaacggcgaggtctggcaatggatagatcctgagcacaccttcggcgagcccccgattgccgatttacgcgaccagcccgatccgcatcacgcggcgctggcgttaatgcaggcggatttacggcaaaacctgcgcgcagatagcggtaagccgctggcgtttcaccagttaatccgcattgatgatacccgctggtattggtatcagcgctatcaccatttgctggtggatggctttagcttcccggcgataactcgccagattgcggcgatttatcgcgcctggcagagcgacgctcctacgccggagtcgccttttaccccctttgcggatgtggtcgaggaatatcagcgctatcgccagagcgaggcctggcagcgtgacggcgccttctgggcgcagcagcgccgcgagctgccgccgccggcgtcaatgtctgccgcgccgttgccggggcggtcggcgagcgcggatattctgcgtatgaaattgagcgcgccggcgggggcgtttcgccaactggcggcgcacatgcctgagataccgcgagcggatcttgccctggcgctggtgacgttgtggctggggcgattatgcgggcgaatggattatgccgccggatttatctttatgcggcggatgggctcggcggcgttaacggcgaccgggcctgtccttaacgtgttgccgctggcggttaaccttcatgcaacggaagatctgccaacgctggcgaagcgtcttgcggcgcagttaaagaagatgcgccgccaccagcgttacgacgccgaacagattgtacgcgatagcgggcgagccgcaggggagacgccgctatttggcccggtgctcaacataaaagtgtttgattatcatctggatcttcctggcatacaggcgcaaacccataccctggcgacggggccggttaacgatcttgaactggcgctttttccggatgaaaacggcggtctggatattgaattgctggcgaatgcacagcgttacgatgatgccacgctctcccgccatgccttacgattgatggcgcttatcacgcagtttgcggataacccggcgctgcgctgcggcgatgcgcaaatgctgctggcggaagaacaaacgcaattagcacaccttaataatacggcggtaacgattcccgccgccacgcttagcgatttggtggcgcagcaggcgcaaaaaacgccagaggcttccgcgttggcagatgcgcattatcactttacctaccgtgaaatgcgcgaacaggttgtggcgctggcgtacgcgctgcgggaacgcggcgttcagcctggcgatagcgtggcggtggcgttgccgcggtcggttttcctgaccttagcgctgcatggcattgtcgaggcgggcgccgcctggctgccgctggataccggttatcctgacgatcggctgcgaatgatgctggaagatgcgcagccgaaactgttaattacgactcaggcgcagctggcgcgctttcacgatattccggggatggaatatttgtgttatagccaaccgctaccggtcagtgacgccactccgctgaggctgtcgttaccgcatcataccgcttacatcattttcacctctggctcgacgggcaggccgaaaggggtgatggtgggacaaacggcgatagtcaaccggctgctgtggatgcaggatcactatccgttgacggcggatgatgtagtagcgcaaaaaacgccgtgcagttttgacgtctcagtatgggagtttttctggccgtttatcgccggggcgaaactggtgatggctgaaccggaagcgcaccgcgacccgctcgcgatgcagcggttctttgcgcaatacggcgtcacgaccactcattttgtgccgtcgatgctggcggcctttattgcctcgctcacgccagcgtcggctgggaaaagctgcgcttccttaaagcgcgttttctgtagcggcgaggccctgccgacggcgctgtgccgcgaatgggagacgttaaccaacgcgccgctacacaatctgtacgggccaacggaggccgcggtggatgtgagctggtatccggcctgtggcgatgagctggcggctgttgacggcaacagcatcccgattggttatcccgtctggaataccggtttacgtattctcgatgcgcatatgcagccggtgccgccgggcgtggctggcgatctctatcttaccggtatccaactggcgcagggctatctggggcgtccggatcttaccgccagccgttttatcgccgatccttttgcgccaggcgaacggatgtaccgtaccggagatgtggcgcgctggctggattccggcgcggtggaatacctggggcgcagcgacgatcagctcaaaattcggggtcaacgtattgaactgggcgagattgaccgcgtcatgcaaacgctgccggatgttgaacaggcggtagcacatgcctgcgtctttaatcaggcggcggcgacgggtggggatgcccggcaactggtcggctatctggtgtcgcactccggtttgccgctggatttaccggcgctgcaggaaaaattacgccaaaaacttcccgcgcatatggtgccggttgtgctgttgcaacttgccagcttgccgcttagcgctaatggcaagctggatcgcaaagccctgccgctgccggacctggcgccgcgcgtgaaagggcgcgcgccgcagtccgcaacggagattgctgtcgccgcggcgttttcccgcctgctgggctgtgagattaacgacgttgaaagtgatttctttgcgctgggcggacactcgctgctggcgatgaaactggccgcgcagctaagccagacgtttaaccgccaggtgacgccggggcaggtgatggtggcgtctgacgtggcgcagttgagtaagctgctcgatactgacgatgacgaacgctcgcgcaatctggggttcgggccgctgttgccgctgcgtgaaagcgatggtccaacgttattttgtttccatccggcgtcggggttcgcctggcaatttagcgtattatcacgctatctcagcccgtcgtggtcgattatggggattcagtcgccgcgccccgctggccctatgcaaaccgcaaccacccttgatgaggtatgtgaacatcatctggcgactttgctcgcccggcagccgcatggcccttattatttattaggctattcgctgggcgggacgctggcgcaagggatcgccgcccggttgcgcgcgcgcggcgaaaccgtggcgtttttggggttactggacacctggccgccggaaacgcaaaactggcgggaaaaagaggcgaatggcctcaatccggacgtattggcggaaattgaacgtgaacgcgctgcgtttgtcgccgcgcagcagggaaatgcctccgacgccttatttaccgccattgaaggcaattatgcggatgccgtccgtttgctgacgacggcgcatagcgtaccgtttgatggacatgctacgctctttgtggcggataaaacggtgccggaaggcgtatcgcctgaacagagctggtcgccgtggatagcgtctttggctatttatcgccagccgtgcgcgcatgtagatattatttctccctccgcttttgaaactatcgggcccatcatcagcgaacttattaataaataacgggcgttgtttctgcctttaacaaattaaatcctgaaacccataataattactaattattatgggttttttattgcaactattaattcttttaacataagtgatacatgctacaggcaagtttaattccgaatatttagcttttcgggcactggcgcgtaaagattgtttcggataattctgacttgctgttagaatctctgacaggaatgtgttctttcattggataaagttttcaggtcatacggcatgccatctcttaatgtaaaacaagaaaaaaatcagtcatttgcaggttattcactgccgcccgccaacagtcatgaaatcgatttgtttagccttatagaggtgttatggcaggcgaaacgtcgtattcttgctaccgttttcgcctttgcgtgcgtggggttgcttctgtcctttctgctgccgcaaaaatggaccagccaggcgattgtcacaccggcggagtcggtacagtggcaggggctggagagaacgttgaccgcgctgcgcgtgttggatatggaggtaagcgttgatcggggcagcgtatttaatctgtttattaaaaagtttagctcgccctcgctgctggaagaatatcttcgttcttctccgtatgtcatggatcaattaaaaggcgcgcaaatagacgagcaggatcttcaccgggcgattgtcctgctgagcgaaaaaatgaaagcggtggacagtaatgtcggcaagaaaaatgaaacgtcgttattcacgtcgtggacattgagttttaccgcgccgacgcgggaagaagcgcaaaaagtgctggctggctatattcagtacatctccgatatcgtcgtgaaagagacgctggaaaatattcgtaaccagctggaaatcaaaacccgctatgagcaggaaaagctggcgatggatcgggtgcgtctcaaaaatcagcttgatgccaatattcaacgtcttcattattcgctggaaatcgccaacgccgccggtattaagagaccggtttacagcaatggtcaggcggtaaaagatgatccggatttttctatttctctcggcgcggatggtatttcccgcaaactggaaattgaaaaaggggtaacggacgtggccgagatcgacggtgatttgcgtaaccgtcaataccatgttgaacaactggcggcaatgaatgtgagtgacgtgaagtttaccccgtttaaatatcaactgtcgccgtctctgccagtgaaaaaagatggcccgggtaaagccatcattattatcctggcggcgttgattggcggtatgatggcctgcggcggcgtattactgcgtcacgcgatggtctcgcgtaaaatggaaaacgcgctggcgatagatgaacggttagtctgatttacccgaaaagccggatagcgatatccggctttgtcatcagtgtgggcgactatcgccgccccagcggtaccaccagcggcgtcccggcaaccggatcgtcgataatcatacagcgcagcccatagattttttcgataagctctgcggtaacaatctctttcggcgcgccctgtgcgacaatattaccttcgcgtaatgcaatcaaatgcgtggcgtatcggcaggcctgattcaggtcatgcaggacggcggcgagcgtatagcctttttcgcggttgagatcgcttaacaactccagcaaatcaatttgatggctaatatccagccacgttgtcggctcatccagcagcatgatggacgtttcctgcgccagcaccatggctatccacgcccgctgacgttggccgccggacagagtgtctacactttgcgccgccagtgaggtgatacctgttgcacgcatggcactggcgacggcatcggcatcttccttacgccagcgggtaaataacggctgatgcggataccgccctctggcgaccagctcttgtacggtgatatcgcccggcgtggtagcgttttgcgccagcaatccgatgcgccgcgccacctctttactggcgtaacgctgtatttgttcgccatccagccagacatggccgtcaacaggcgtcatcagacggcttagcgtacgtagcaacgtcgacttgccgcagccgttagggccgatgatggcggtaaaatggccgtccggaatcgaaacattaaggttttttgcgacggtatagctgccataacccagcgttaactggtcgccgcgcaaacgggctacggattcggtcattttttgcgggactcctgaattaacaagacgataaggtaaataccgccgaggctgacggtgaccacgcccactggaagctgataaggcataaacagttgctgcgcgcacgcatcggcggccagtagtaataacgcgccgcacagcgccgactgggttaatccccagcgcgctgtgccgctaagacggcgggcgatgtgcggcgcgacaagggcaataaacgagatggggccagccagtgccgttgccgcagcggtgagcgacaccgccaccagcatcagcatcaggcgtgaccgctccacgctaacacccagcgcgcaggcgctgtcatcgcccatctccagcagccgcatacgacgcaccagtagcgcggcgcctgtcagcatcaccataatcagcggcgccgaaggccaggtttttgcccatgtcagaccgttgagcgacccggcgttccataagccagcggtgagcgccgtttccagcgacgcctgcaacagaagccaggtattaaaggcgactaacatcgcgcggatgccgataccgatgataatcagccggaaagtttcaatcccgttacgccaggcgagcagccagacaatcaatgacgtgacgataccgcccgccattgccgccagcgcgatcgcggtaagatgctggccaaacaggaccattgcgaccagtacgccgctccaggcgccggtattaaagcccatcacatcagggctgcctagcgggttacgcatcaacgactgaaaaatcgcgccactgacgccaagcgcagcgccaatcagtagcgccattaatacgcgcggtagtcgccattcggttacgacaagggtgatgttacgcggcgcgtcgcccagcagcgcggcaataatctgcccggtctcaaggggcacggcaccgctttgcaggctccataagccaatggcgaagcagccagccgccagaagcaggcagcttacgataagccgacgagaaagaaacatcacaggccgcctccgctcgatttacggcgtaccagaaagataagtaccggcgcgccgataaacgcactgacgaccgatacgcggagttcgcccggcactaacagacgaccaataatatcggcaaaaagcagcagagcaggggttgccagtagtgttaccggcagcgaccaacggtggtctgcgcccaccagccaacgcgccatatgcggcatcatcagaccaataaaggcgatagggccgaccagcgccgttgcgctgccgcacaagacggtaatcgccagtaaaccgataagttgggtgcgcgccactttactccccagcgccgtcgcagtatcgctgccgaggctcaggctattcagcgcacggctcagaaatagcgccacgatcccagcgataaccacgggcgcaagcgcgactttcaacgtttgcaggctacgaatgtccagcgatcccgcctgccagaagcgaagctgatcataaacctctggatttaacagcgcgatgccgctggtcaatccttccagtaccgcgccaagcgccacgcccgccagtgtcaggcggaccgggcttaactggccgccgccctgactaccggtgaaggcgacaatcagtgatgcgataagcgcgccgctaaatgccatgaaaagctgttccagcggcgtggagaaaccaaacagcgccgcgcccagtacaatggcgaagctggcgccgttgttaacgcccagaatccccgggtcggcgagcgggttgcgagtgagtgtttgcatgagcgccccggcgaggcccaacgcgccgcctgccagtaatccggccagcgtacgcggcaaacgcgcatccaggacgatggtgcaatcggcgctttggcacacgccggtgaacgcctccagcacgacggcggcgggcagcggtttcgcgccaatgaccaggcttaaaaccgcggcgagactcagtaataacaacaatccgggcacggcaaacgcgcgcgtcacggaaaacgagcatgacatagtaacttccctgataatgatagtaattatcgttatctatcttatttggttatgttagcatgtgcagccattgaatggatatttaaaaaaactcgcattaaggcgttgtaatgaatcgacaatcctggctgctcaatctcagcctgttgaagacgcaccctgcatttcgcgcagtatttctggcccgttttatctctattgtctcgctggggctgcttggcgtggcggttccggtacagatccaaatgatgacgcactccacctggcaggtagggctgtcggtaacgttaaccggcggcgccatgtttattggcttaatggtgggcggtgtgctggccgatcgctacgaacgtaaaaaggtgattctgctggcgcgcggtacttgcggtattggctttattggcctgtgcgtgaacgcgctgctgccggaaccgtcattgctggcgatatatctccttggcctgtgggacggctttttcgcgtctctgggcgtgaccgcgttactggcggcgacgccagcgctggtcggaagagaaaatctgatgcaggccggcgcgattaccatgctgacggtacgtctgggatcggttatttccccgatgttggggggcatattgcttgccagcggcggcgtagcctggaactatgggctggcggccgccgggacgtttattacgctattgccgttactgacgctgccgcgactgcctgttcctccgcagccgcgggaaaatccatttatcgcgttactggcggcatttcgttttttgctcgccagtccgcttatcggcggtattgcgctgcttggcggcctggtgacgatggcaagcgcggtacgcgtcctctatccggcgctggcgatgagctggcaaatgtcggcggcgcaaattggtttgctgtatgcggcaattccgctgggggcggccattggcgcgctgaccagcggacaactggcgcatagcgttcgtccggggctcattatgctggtttcgacagtcggttcttttctggcggtggggctgttcgccatcatgccggtctggatcgctggtgttatctgtctggcgctatttggctggcttagcgccatcagttcgttattacaatacactctgctgcaaacccagacgccggaaaatatgctggggcgaatgaacggcctgtggaccgcgcaaaacgtcacgggagacgctatcggcgcggcgctgttaggcggtcttggcgcaatgatgacgccggtcgcttccgcgagcgtgagtggattcgggctggtgattatcggtttgttgctgctgttagtgctgggcgagctacgtcgttttcgccagacgccgccggttagcgatgctggctgatgaaggggcgtttatccgactgaccaaatcggtctggtcagtcggataagactccgataaggctaaaacagggcggcaagccggttaagcaacaatgttgcgctgtaataatccagacggaacgtctccgtacccagggcatagacgcgcttattttgcaccgctggcaggtgcgccagcagcggattggcgtaaagggccgcgacatctttgttgtcgccggcaaacaggaaaagagattcgccgtttaacccggcggccagattttcaccgccaagctgaatgatatcgtggcgcttaccctggcttttgctggtttgcagccctcggggcaatgtcgccagcgtaaagcctaactgtgtcaatagcttgccttgtgctgattctggcgtccacagattggcgctatgcgcggcaggggtatacaccagcgcgctaaccggctgcggcggcagggcgattcgctgtttaaccgtcgtcagttgcgtctcaaactccgctattcgcgcggcggcctgtttctcctgaccggtgatctcgccaagttgcgtgagcaaactctgccagcttttatcgtcataattgatgacgagcgtcggcgcgatagcggagagctgatcgtaaagcgccagcgcggagtcgccgccggtggcgctaatcaaaatgagatccggcatttgcgcggcgaccgtttcggcattcggttcgccgatgtacagccgggcgacatggcgagcctttgctacgtcgctccactggcgcataaacccttgatcgtcggcaaagcggttattcggcgtagtggctccgctggcgacgacgggcgcatcaatcgccagcagcgagcctgtcaacgtcacgctggtagagacgatacgcgcgggtttgtggtccagagtatgaacgccgcggctgtcctggatttgccggggccaaccggcgtcctgggctaaggatattcctgaaattgatataccaaccactaaaagcagccaacgataaaaggcggggagtctcacaatagcgtcctgttattaataaagttaatgcttctcattttcatgtcagcggcagcgagatgcaagccttagtgccatttaactcatgaccagagttgacagagcgacgttttactcttaggttagcgcactaaaaatagaaataataatcattattatacacaaaatcattcaagaagcatcgcaacggcaagggaagaaatccccgcgggcatagataactgtgtgaccggggtttctgatcgcagccaacaaagaggcagcttgaaagatgaagtgtatataagcctttatcattggaggatgatatggatatgtcactggccgaggacgctcaggagacaatggcaacgcttgctcccgatcgctttttcttcatgtcgccgtatcgcagttttaccacttccgggtgcttcgcccgttataccgagcctgcggttgccggagattcgccggatagccctttccagcagaaattgcgccagcagtttgccgaggccaaatcgcagggcatcgccaaccctatcctggtgggggcgatcccctttgatactcgtcagccgtcgtcgctatttatcccgatggcgtggcagtccttttcccgccagcaaaagcagcgcacggcgcgttattttactgaccatcagtcgctgacggtgacggcgcgaaaggcgattccggagcaggatgcttttgaagcgatggtcgcacgcgcggctatgctgaccgccacgccagacgtcgataaagtggtgctttcccggctgatagatatcaccactgatgtggcggtggatagcggagcattgctggagcggctggttgcgcagaatccagttagttacaacttccatgtgccactggcggatggcggcgttctgctgggcgccagccccgaattgctgctacgcaaagagggcgagcggtttagttcgctgccgttagcaggctcggcacgtcgacagccggatgacgttctggatcgcgaggcgggaaaccgactgctggcttcacaaaaagatcggcatgaacatgagctggtgacgcaggcgatgaagcagatcctgcgcgatcgcagcacggaactgcaattaccttcctctccgcagttgatcaccacgccgacgctatggcatctcggtacgccgtttgagggcaaggccaacgccggagaaaacgcgctgacgctggcctgtctgctgcatccaacgcctgcgttaagcggtttccctcatcaggtcgcgaaaaagctgattgctgaactggaaccgttcgatcgtgaactgtttggcggcattgtcggctggtgcgatgccgaaggaaacggcgagtgggtagtgacgattcgttgtgcgaaattgcacggtaatcaggtgcgcctgttcgctggcgccgggattgtccctgcctcttcgccagtcggcgagtggcgggaaaccggcgtcaagctctctacgatgttgaacgtttttggactgcattaaggaacgatgatgcgtatacctttcacccgttggccggatgaatttgcccgccgttatcgtgaaaaaggctactggcaagacgtgccgttgaccgatattctgacccgccacgctgacagcgacaagacggcggtcattgaaggcgagcgcgcattcagctatcgccagctcaaccaggccgcagataatctggcctgcagtttacgccgtcagggcatcaaacctggcgaaaccgctctggtacaactggggaatgtaccggaactgtatatcacctttttcgccctgttgaagcttggcgtagcgcccgttctggcgctgtttagccatcaacgtaccgaacttaacgcctatgcgatgcagatcgcgccgacgctggtgattgccgatcgccaacatacgctgttcgccggggaggactttctcaacacgtttgtggctgaacaccgctctgtgcgggtggtgttattgcgcaacgacgacggcgatcacagcctggacgcggcgatgcggcaggcggcggaagatttcactgccacgccatcacctgctgacgaagtggcctactttcagctttccggcggtactaccggcacgccaaagcttattccccgtacccataacgactattactacagcgtgcgccgcagcaatgagatttgcggtttcaacgaggatacgcgttttctgtgcgcgattcccgccgcgcataactacgccatgagttcgccgggcgcgctgggcgtctttcttgccaaaggaacggtagtgctggcgaccgatcccagcgccacgctctgtttcccgctgatcgaaaaacaccagattaatgccacagcgctggtgccgcccgcggtcagtctatggctacaggctatccaggagtggggcggcaatgcgccgctggcgtcattaaggttattgcaggtcggcggcgcgcggctttctgcgacgctggccgcccgtattccggctgaaattggctgtcagttgcagcaggtcttcggtatggcggaagggttagtgaactatacccggctggacgatagtccggaacggattatcaatacccagggaagacccatgtgtccggacgacgaagtgtgggtggcggatgccgacgggaatccactgccgccgggcgagattggtcgtctgatgacgcgcggcccctatacttttcgcggctatttcaacagtccgctacacaatgccagcgcctttgacgccaacggtttttactgttccggcgatctgatctccattgatcaagacggttacatcaccgttcacgggcgtgaaaaagatcagatcaatcggggcggcgagaagatagccgccgaagagatagaaaacctgttactgcgccacccggtggtgatccatgcggcgctggtcagcatggaagatgaactgctgggagaaaaaagttgcgcatatctggtggtaaaagagccgctgcgagcggtacaggtacgccgtttcctgcgagagcagggcgtggcggaatttaaattaccggatcgcgtggagtgcgttgcgtcactgccgctgacgccggttggtaaagtcgataaaaaacaattacgccagcggttggcgtcacgttcaccgctctgaaggagaaagagagatggcaatcccgaaactacagtcttacgcgctgcccaccgcactggatatcccgaccaacaaagtgaactgggcatttgagccggagcgcgcggcgctgctcatccacgatatgcaggattactttgtcagcttttggggccgcaactgcccaatgatggaccaggtgattgctaatatcgccgccctgcgccagtactgtaaggaacatcatatcccggtctattacaccgctcagccgaaagagcaaagcgatgaagatcgcgcgttactcaatgatatgtgggggccgggactgacgcgctctccggaacagcagaaggtggtagaagccttaacgccggatgaggcggatacggtgctggtgaagtggcgctatagcgcgtttcaccgctcgccgctggaacagatgttaaaagataccggacgtaatcagctcatcattaccggcgtgtatgcgcatattggctgtatgaccaccgctaccgatgcgtttatgcgcgacattaagccgtttatggtggcggatgcgctggcggatttcagccgggaagagcatctgatggcgctgaactatgtggcggggcgttccggtcgcgtcgtcatgaccgagtcgctgctgccgacgccggttcctgccagtaaagcggcgctgcgggcgttgattctgccgttgctggatgagaccgacgagccgctggatgatgaaaacctgattgattatggcctggattcagtacgcatgatggggctggcagcgcgctggcgtaaagtacacggcgatatcgacttcgtgatgctggcgaaaaacccgaccattgacgcctggtgggcgctgctttctcgcggggtagagtaatgaccggctttgatttttcagacaaaacggtatgggtgaccggggcggggaaagggatcggttacgcgacggcgctggcgtttgtcgacgccggggcgcgggtgatcggcttcgatcgcgaatttacgcaagagaattatccctttgctaccgaagtcatggatgtggcggatgccgcacaggttgcgcaggtgtgccagcgtgtgttgcaaaaaacgacgcggctggatgtgctggtcaacgccgccggtattttgcgtatgggagcgaccgatgcgcttagcgtcgacgactggcagcagacgtttgcggtcaatgtgggcggggcatttaacctgttttctcagacgatggcgcagtttcgccgtcagcagggaggggcgattgtcaccgtagcctcagatgcggcgcatacgccgcgcatcggtatgagcgcctacggcgcctctaaagcggcgctgaaaagcttggcgctaaccgtagggctggagctggcgggctgcggggtgcgctgtaatgtggtgtcgcctggttcgactgacaccgatatgcagcgcacgttatgggtgagtgaagatgccgaacagcagcgtattcgcggtttcggcgaacagtttaagctcggcataccgctcggtaaaatcgcccgtccgcaggagatagccaataccattttgtttcttgcctccgatctggccagccacattaccttgcaggatatcgtggtggacggcggttcaacattgggagcctgacgatgatctggaaacggcatttaacgctggatgaattgaacgctaccagtcagaacactctggtggcgcatctgggcattgtttacacccgtctgggcgatgacgtgctggaggcggaaatgcccgtcgatgcccgcactcatcaaccgtttggtctgctacacggcggcgcatcggcagcgctggcggagacgttgggatcaatggcgggttatctgatgacccgcgacgggcagtgcgtggtcgggaccgagttaaacgccactcaccaccgcgccatctcgcaggggaaagtacgcggcgtttgcctgccgctgcatctggggcggcagaatcaaagctgggaaattacgctctttgacgagcaggggaggcgctgctgcacctgtcgcctgggaacggcggtaatgggatagttctggcaaagtaaaatgcaattgcagcattaacgaagaaaggaagtgatctggttaacactgtaatgtaaaaaatgggtaacaatccggttttatcatgttgttgtgttgttaattacggtaaaggtgttatagaaacaaaatgtaacatctctctggaacacccaaacggacaacaactatgaataaatcagggaaatacctcgtctggacagcgctctcagtattgggtgcgtttgccctgggctatattgcgttaaatcgtggggaacagatcaacgcgctatggatcgtggtggcgtcggtctgtgtctatcttattgcgtatcgtttttatgggctctatatcgccaaaaaagtgctggcggttgacccaacgcgtatgacgcccgcggtacgtcataatgatggtctggattatgtcccgaccgataaaaaagtgctgttcggtcaccattttgcggccattgctggcgcaggtccgctggtcgggccggtactggcggcgcagatgggctatctgccggggatgatctggctgctggcgggcgtcgtgctggcgggagcggtgcaggactttatggtgctgttcgtctcgacccggcgcgatgggcgttcgcttggcgagctggttaaagaggagatgggcgcgacggcaggggtgatcgcgctggtggcctgctttatgatcatggtgatcattctggccgtcctggcgatgatcgtggtgaaagcgctgacccatagcccgtggggaacgtacactgtcgcgttcactattccactggcgatttttatgggcatctacttgcgttatttgcgtccggggcgcatcggcgaggtgtcggtcattgggctggtatttcttattttcgctattatttccggcggatgggtggcggcaagcccaacctgggcgccgtactttgattttactggcgtgcagcttacctggatgctggtgggttatggttttgtcgcggcggtactgccggtctggctgctgctcgcgccgcgtgattacctctctaccttcctgaaaattggtacgattgtcggtctggcggtcgggattctgattatgcgtccgacgctgactatgccggcgctgaccaaatttgttgatggtaccggaccggtctggacgggcgacctgttcccgttcctgtttattaccatcgcctgcggcgcggtctccggtttccatgcgctcatctcctccggcacgacgccgaagatgttggccaacgaaggccaggcctgctttatcggctacggcgggatgttaatggaatctttcgtcgccattatggcgctggtctccgcctgtattatcgatccgggtgtttactttgcgatgaatagcccgatggcggtactggcgccagcggggacagcggatgtcgtagcttctgccgcgcaggtggtcagtagttggggtttcgctatcacgccggatacgttacaccagattgccaatgaagtcggcgaacaatccattatctcccgcgcaggcggagcgccaacgctggcggtagggatggcctacattttacatggcgcgttgggcggcatgatggatgtggcgttctggtatcacttcgccattctgtttgaagcgctgtttattctgacggcggtggatgcgggcacccgtgcggcgcgctttatgttgcaggatttgttgggcgtagtgtcgccagggctgaaacgtaccgattcgttgccagcgaacctgcttgctacggcattgtgcgtgctggcgtgggggtatttcctccatcagggcgtggtcgatccgttgggcggtattaacaccctgtggccgctgtttggcatcgctaaccagatgctggcgggtatggcgctgatgctttgcgccgtggtactgttcaaaatgaagcgtcagcgttatgcgtgggtcgcgctggtgccgacggcctggctgctgatttgtacgctgacggcgggttggcagaaagcgtttagtccggatgcgaaaatcggcttcctggccattgccaataagttccaggcgatgatcgacagcggcaatattccgccgcaatacaccgaatcgcaactcgcgcagttggtattcaataaccgtctggatgccgggctaaccatcttctttatggtggtggtcgtggtgctggcggtcttctctattaagacggcgctggccgctctgaagattgataaaccgacggcgaatgaaacgccgtatgagccgatgccggaaaatgtggatgagatcgtgacgcaggcgaaaggcgcgcactaatctttttacatcaatagccctctccagaataaggagagggcatttgaatgacaggtgacaacgatgttcgatacgctttcgaaagccggaaaatatctgggacaggccgcaaaaatgatgattggcgtgccagactacgacaactatgttgagcatatgcgcataacgcatccggatcagacgccgatgacctatgaagaatttttccgcgagcggcaggatgcgcgctatggtggaaaaggcggcgcgcgttgctgctgagggttgccaggcctgataaacgcaacgtcaccaggctatattctgaaaaattcaactttttcaaacgccgcacgcagggtgtctggcgttaacgtcaccggtaaatagtggatggattcgaccgggcgcagggtatgcgcgatgaccctatcgatctcggcggtgttatgaatatccacgtccagttcgctaagccgggccggcagatgaaatcgccggtacgctgtaatcaattgcgccagcacgtcatcttgtcccagtagcgcgctttgcaccagaatgccataagccactttcgttccgtgcaggaatttttccgtttgcggcaggacggtcagaccgttgtgtaccgcatgggcggcggcgacacgggtatagcgttccccgaggccgccgaccataccgccgccagcaataatcgcatccaccacgtcgcaaaatgcctgggtcagccgacgctgctgtttatccgctaatgcttgttcgctgctgtccagcaggagatcgcgaatagcgcacgcgctgttaatgcccagccttacggtcaatggcaatgtttcaggctgcggcgcaagcacaacggcttcataccatttcgccagcgtatcgccaatgccagctaacagatagtcatcgggcgcctgcagaataatgcgcggttcgaccagcaccagaaaattggcatcatcaaaaatttcgaactgtaacgcctgtcccgcgtcgttataccagacggaaagcggtgtccaggcggcgcaggttgccgcgattgtcgggatagcgacaaacggcagcgccagacggcgggcgagcgctttggcggtatcgagcagcgcgccgccgccgacgcctatcaccacctgacgatcgtcgttgcaggcgtgcgccagttgggcaacatggcgttcgctacaatggccggtaaacggcagatgctttgcgccagcacgttcaaacgcttccggcaggtaaggccgggcggcggcaatcgcgcgttcgccgtacacccaaacggcgtgggaaagctgttccggcgtgaaaaagtcggtcagtctttcgaggcttcctgcatgggaaaaataattcgccgggccggtaacgacgcggatctcagtgtggttcatgttgtgttgtccttagggtcttctcaccgttgttattatatttagacatctaaacgtcttgattgccaaatactaacaccctgtgatagtgtgtcaacaaccacatcactggcgggtatgaagataatgagaaataacccactgattccaaaaagcaaattgccaaatcttggtaccacgatttttacgcaaatgagcgcgctggcgcagaaacatcaggcaataaatttatcgcaaggcttccctgattttgatggtcctcgttatttgcacgagcggttggcttatcatgtcgcgcagggcgcgaatcaatatgcgccgatgacgggggcgcaggcgctgcgggaggccattgccgataaaacggcggaaatatatggttatcgacccgatgacgtcagtgatatcaccgtcacagcgggcgcgacagaagcgctgtatgcggcgattaccgcgctggtgcgggcaggggatgaggttatctgtttcgatcccagttacgacagctatgccccagccgtggcgctctccggcggcgtgttaaaacgcatagcgcttacgccgccgcattttcgcgtcgactggcaggcgttttcggcgttgcttagcgagcgcacgcgactggtgatcctcaatacgccgcataatcccaccgctaccgtctggcgtcaggcggatatcgaggcgctgtggcaggctatcggcgagcgggaaatttatgtgttaagcgatgaagtgtacgaacatatttgttttgccgccgaaggtcatgccagcgtattggcgcaccctcagttacgagagcgggcggttgccgtttcatcgtttggtaaaacctttcatatgacaggatggaagattggttactgcgttgcgcctgcggccattagcgccgaaatacgcaaagttcatcagtacctgacgttttgcgtcaatacgccggcgcaactggcgctggcggatatgctgcgcgccgcgccggaacactatcgcgcgttacccgatttttaccggaaaaaacgcgatgtgctggttaacgcgctggcgcaaagccgattaaaagtgctgccctgtgaaggtacctattttctgttaatcgattacagcgcagtgtcgacgctaaatgacgttgagttttgtcagtggctaaccgaagaagtcggtgtcgccgctattccgctctctgtcttttgcgccgcccctttcccgcatcagcttatacgtttatgtttcgctaaacaggaatcaacgctgctggccgccgcagagcgcctgtgtaaactgtagttatttaaccgtccacgctctggagaatcgacggtctgcaaaaagctcctgcaggccgttgatctgtttcaggcgcaggacttcatcggcgtccatacctaactcctggccgattttgctctcgtcccagcctagcagagaaagttcgcgcacgatttctgacatggcgtggatctggtggcgcccgcgcgcgcggttatgccgaatggttgccgccatgcgttcgtgacgttctctgtccagacacgttatcggcaggtagcctttcagacgccttttcagggccgcttttcctttgcccagctcatgacggtgaaaaccgtctacaatctcgtactcctccgtattggcctttaccaccacgatcggctgagtaaacccatcttgttcaatcgatttaagcagcagttttttctccggcggcgcaacgttattcgggttgtagtcattaggtgaaatatgatcgtttttcacccacaggacacaatcgacaggctcatcgcgaaaaggactaacgctatgtatcgccattctaaattcattaatggcggcgatcctctcctcttcaggcagttcagagagaaagtgagttatttcggttgtgagtcggtgttgcataagatcccccattcctggcgtttagctttcatacgttcgttataacgctggtaattcttaggttttgtcggactgaatgacagcgcccggcaccagtaatcattgttcagtaatactttgcagatccgtcgccacgacggaatatcgcgcgatccgatatcgccatgctgcgtttgtggaatggtgtgcatgccttttttcttataccactgcaaataaacggcgattttattacggtaatgttcggcagtgacttcaggcatactgtgtagcaggagcagcgcgtactcttcccagttaaggtgatcgggttttaaaattttccggtggccgtaaaaatggctgtcttgtccggcgtatattcctccgctgagtgcgccgctgactctggcgcacatggccgcccagcgctcaggttcgataacatgatacagccataacccctgtcgttgttccgggccgaacggttcgcaaatacgcatgtaacggggcggtactccagcctgatacatcaaattatacaaagggttacatggtttacctgttttggcgaaccaggtccagatatctgcggttttccagtcatagatgggatagatataccaggtgtgccccttaggggctaacgtggtccagggcttatcgtcggcaaagcgcagcttatgcgagttagcgatagcggcaaatcggttataggattcgtcggaacgaataccgaccagcatagcggcaggacgtttttctgaaaaccagtcggcaaaatcgcgaacgaactgttcaaaggtcatgccgtgttgataaaaggaaaaaaaggccggatcggtaatcgcatcttctggcggttgtcgtacccagtcggtacccggctgccaacactgccactccggctggtattgtgaaagggaattttgtgtggttaagggtaatgcgacccaataaaaacgctcaataacgtccgcgtagtattcacgtaacgattcaatataggtgatggtacaggagaattgcgcttcccagtcaatgaagagaacatggatctttttattcattttgcgcgccaacgttgccgtcaggtgcaacataagtcctgaatctttaccaccagaaaatgagacgcagacccggggtaaggtttccagggtccacattatacgctcttgagccgcttccagaacattttgctcgagcggaactttataaaccgacatctctggatagtctccgatgtgttaactacagtatattcgaaataattaacataaaggataagcagattagatgaacttgcaatgctttattatatttgtaaaataaatatattccataaacatatacattaaatttatattaatatccgttatctgaccttcttattaatgtttttttgtgatgtgctcaatgagctcagcaaatccgctattattcagcgaagccctattatacataagatagaattgtatgggagcaatggtaaaaggtatggtgacttttttaagtttgatagaggaagagtaatagtcaaaaaatgtttgtggtaaaaaaccaataagctccgtggagctgatagagttggcgatggtcatcagcgatttgcttctgaaaccaattattctttcccccagcacatcatccataagtgaatgatattctttcataccggttgcccgggagacgagttgcgtaaatgactcttgtagaatttcgtcgatagtggcggtgtcgcctagtcggggatggttttcactgcaaaccaggatgcattctagcctattaaagtgagtacaaacaatagaacgattattcagtggggccattgaaaccacaatatctgctttgcggtaggcaagcagatcttcaggcagttcgtcagtggtcaaaatgtcgtgatgttcaatttcaacctgtggatctttgcggatatatttaactaatttcatcacatattgggtgatcaacagctgtgggctgtagataataaattttttcttcaggctggactgattcattatattaatagtttgttccaggctgttaagattattttctaaatgataatgtaaattaatgcctgttacggtaggcgtaattcctttgcctgaacgaataaatagagggtcgttgaattgcgtgcgcaggcgttgcaatgactggcttacggcagaaggtgtaatatagagtgtttctgctgctttgctaatgcttaaatgttgatagatacattcaaatataaccaacaggttaagatcaaattttttaaggtcgtaaaggttagccatagtatgttcccggcattatcatggtatcttccatgattatgacttaatctcaataatttaccagagttatgtttattaaacttaatgtagagtttatttaaactaaaataccacagttatgaatattttagcgagtaaataattacagtaaaggcggacataacgtacacttttataaccacgccgttagtctaaaaaggctgtgtcggatgacatgctggtctggcgtcgcgttaatgccagtcagaggttggcccgacaaacgtagcgctatcgggcgtggtacggttaagctccagctttgctaatttctgcgttaaggctgccccatcatggcgtccagttgcgctttttccggtaaacccacaacctgttgcaaaatcttatctttattcatgtaataaattgctggcgtcgcgttagcgccaagatcgtccattagctgctgattctgattaatgactttcatctgcgccggggggatggacgccggaacttccagcttcatctttcctgcggaggcttcatagtcatgccaggttttcgccgggtctttcgcggctaaaatcgctgcggctgtggccgggctttccggtttaatcacgccgaccagtaatgtgcgtaattgtaccttgccggattcgacccacggacgagcttgttgccaaaactgcttacaataggggcagaaagggtcggcgaagacatacagcaccaccggcgcgtcttttttaccgtcgagtatccatgacgctttttccattttctgccacatttcacgtccggccggtgcatagatctctttttctatcagggcgttgctaagattttcgcctttttcattatacatatagccggaaatcgcgtgtttaccgtccggcgtcaggtaaatcgtgacgcccatatcctgatactttccgagatagcccttcatgccccccggcgcctcgaaggatttcaggatagttataccctgtttttcaatggctttaaccggcgcaggcagttcttccgcgtgggcgagaatgggcagcatagcaagcagcaatgtacgtttaatcatattttttccttttaatatcaaagcgaaaagagtattaatgatgatgcctatcacagacataggtaagagctggcgtgccaggattgccctttctgtgctggggtgatgtaatccttttcgctgttacagcctttgttaaggtaatgtagagcgcaacacttagccagcatatacgctatggatttcgagttgcagacaatacgtctgtaatttgcaagacgagtcgtactggctctgaagttacctacgggtagttcaggtaatggggccgcctgtcaggcggcctttttactttagatggctgacagggcgcagtgttcacaatgtcgcccgaatcgggttgttagttaacgcttattgatttgataatggaaacgcattagccgaatcagcaaaatttcgttaacttactcctcaacgaaaacacggaggaagtatagatgtccttaattaacaccaaaatcaaacctttcaaaaaccaggcgttcaaaaacggtgaattcattgaagtcaccgagaaagataccgaaggccgctggagcgtcttcttcttctacccggccgattttacctttgtttgcccgactgaactgggtgacgttgccgaccattacgaagaactgcagaagctgggcgtagacgtttattccgtctcaaccgatactcacttcacgcacaaagcatggcacagcagctctgaaactatcgcaaaaatcaaatatgcgatgatcggcgacccgactggcgccctgacccgtaacttcgacaacatgcgtgaagatgaaggtctggcagaccgtgcgacctttgttgttgacccgcagggtatcatccaggcgatcgaagttaccgctgaaggtatcggccgtgacgcgtctgacctgctgcgtaaaattaaagcagcacagtacgttgccgctcacccaggcgaagtatgcccggcgaaatggaaagaaggcgaagcgactctggctccatccttagacctggtcggtaaaatctaaatttccgtcgtctttcacgccatagctgcgttggcgtcgcctgctcaccccggtcacttacttcagtaagctcccggggattctcaggctagccgccttactctgacgtgaaatactttggaaattgtttcagtcatgggcgcacccgcgcccatttcatttcagcaccatgacgcaagttgcattaatgcagtcccgcgaagtcggcttgcatgatgatgttttcagagagggaagaagaatgctcgacacaaatatgaaaacccagctcagggcttaccttgagaaactgaccaaacctgttgagctgattgccacgctggatgacagcgctaaatcggcggaaatcaaggaactgctggctgaaatcgccgagctgtccgacaaagtcacgtttaaagaagacaatactctgccggtgcgcaagccgtctttcctgattacgaatccaggttctcagcaagggccgcgctttgccggttctccgctgggccacgaatttacctcgctggttttggcgctgctgtggaccggcggtcatccgtcaaaagaagcgcagtcgctgctggagcagattcgcgatattgacggcgattttgaattcgaaacttattattcactctcctgccataactgcccggacgtagtgcaggcgctgaacctgatggcggtgctgaacccgcgtattaaacatacggcaattgatggcggcaccttccagaacgaaatcaccgaacgtaacgtgatgggcgttccggcggtatttgttaacggtaaagagttcggccagggacgtatgactctgaccgagattgtcgctaaagtggatactggcgcagaaaaacgcgcggcggaagcgctgaacaaacgcgatgcgtatgacgtactgattgtcggctccggcccggcgggcgcggcggcggcggtctactcggcgcgcaaaggcatccgtaccggtctgatgggcgagcgcttcggcggtcaggtgctggataccgtggatatcgaaaactatatctcggtgccgaaaaccgaaggccagaaactggcgggcgcgctgaaagcgcatgtcagcgattacgacgttgacgttatcgacagccagagcgcaagtaaactggttccggccgcaacagaaggcggcttgcatcagattgaaacggcgtccggcgcagtattgaaagcgcgtagtatcatcatcgccaccggcgcgaaatggcgcaatatgaatgtgccgggcgaggatcagtatcgcaccaaaggcgtcacctattgtccgcactgcgacggtccgttatttaaagggaagcgtgtggcggtcatcggcggcggcaactctggcgttgaagcggctatcgatctggcaggtattgtagaacatgttacgttgctggagttcgcgccggagatgaaggcggatcaggtgctacaggacaaagtgcgtagtctgaaaaatgtcgatatcattttgaatgcgcaaacgacagaagtgaagggcgacggttcgaaagtggtgggactggagtatcgtgaccgtgtcagcggcgatattcatagcgtcgcgctggcagggatttttgtgcagattggtctgttgccgaatacccactggctggaaggcgcgcttgagcgtaaccgcatgggcgagatcattattgacgccaaatgtgaaaccagcgttaagggcgtcttcgccgcaggcgattgcaccaccgttccttacaaacagattatcatcgccacgggcgaaggggcgaaagcctcgttgagcgcctttgattatctgattcgcaccaaaatcgcataaaaagaagtaagcacacctgcaaggccagttaactggccatcgtaaatggcccgatagtgtaagctattcgggcctgcggtgtttatgcctggggaacgcaccgggtaaaacaccttcttcattatcaatactctgaaaccgtctgttaataacagacggttttttatttcaacggtattctgtttttaaactttgaaacaataaaaaagccttctacggatttaactggaatttttctgtttttttatcaaagaaagattaagcgcttccgttaacatgcccattcttttttcttgatttatattgcatttgtatgtgaggttatttattcatggattcaatctatgaatcactgacggaattagaaaaaacagggcttacattgcgtgatttttttaattctcatgatagtcgttcactgaaatctgcctacgtgagattaaatcccactgctgcggtaaaccttaccgatcgggcgtggctggaggcggagtatgactttaatgcgctattcgtcggtcctggcaagctgctggctgcgcctttcgcttcagtgtatctggaagatgatgcgctggtgatgggaaaggcgacgctggagatacgggattttatggcagcgttgggattatcggttaatcaggagagcaatatccctgacgatcatatttcctgcgtgctggaattgaccacactattactggctaatacccggcaaacgtcaccataccgctctactctcactcaatatatcaataactatttaacaaagtgggtgccattatatatcgaaaaaataaaaactcatgcacaaacgaccacgttatatacggtggcggacatcttattttattggcttgctgaattaaaacgagaatatcaatatgagtaatgagacgggacatctgaacagacgttcttttttaaaggggatagtggcactgggcgccgttgcggctttacccggaggattactgacctcccgatgcgcgcttgcgcagccgcctgttccctttaaccctaaaacgtacaaaatttatcgtaacgcgtgtccgcgtaactgctatgacacctgtagcctcaagacatgggtaaaggacggggtcattactttcgtggaaggtgcgccggaatcaacatttactcacggtaccccttgcgtcaaagggttaagctatccgcgccgggtttatagccccgatcgtattaaatatcccatgacgcaggacgttcgcggtagcggcaactggcgtcgcatctcatgggaagaggcgatgcagcgcattgccgccaaaatgctggagattaagaaaaaagacggttctatgctcggtctggcgctgaccaaatattccggtaagtttggcgtgctgaactatgccgttgaagggatgatgtcctcgcttggctataccacccgttttgccggtacgccgtgctggcctgccggtatcgacgcgcaaaactacgacatgggcgacatgtggtgtaacgacccggaagatatggtgaaagcgaaatacatcattatctggggcgccaacccggcctggtgctcaatgcacagcatgaagtacatctatcaggcgcgcgagaaaggggcgaaggtcgtggttatcgacccgctgctgtcgcagactgctgccaaagccgatctctacctgcgcgtacggcctggctcagacggtgcgctggcgctgggaatggcgcgtcatctggtggataaaggcctggtggatcaggattttgttaacaacgatgctcacggctatccggaatttgaagcctatctgcgtaaccatgtaaccgtggagtgggcggcagaaatctgcggcctgtctgcggatgtcattcgccagctggcggaagagtttacggcggttaagccggccacggtctggattggttacgggatgcagcgtcatgtcaacggcggcgccaacgttcgcgctatcgatgcctttgtcgctatgtccggcaacatcggtgtcgaaggcggcggcgcgcgttatggccatctgcatacctggggctttaactataacgccatgctgcagaagccgccggtgggcgctattggcataccgggagcggcgggcaccaccagtgaattcggggctgccgctggcagcgacgccgtgcagtactccgatcgctctctgaatatcaaccagacggcgcaggggattctggaggccaacgatccgccggttcgtatgctgtgggtcgcctgtaaaaacccgtttgcccaggatttcgatcgcagcaagatgaaaaaagcgtttgaaaaactggaaatggtggtctgcgccgatcagttcttcaacgaaacggtgcaacacgctgatatcgtgctgcccgttaccaccgcgtttgaagagtggaacgtggatgcttcttactggcactactggctttccattaatcagccggcgattaagccgatgtatgaagcaaaatgcgaccttgaaatcgctaccatgctgtcgcgcaccattaataagatggcgccgggttcctgtaccttcccgcaagagttcgatcacaagcgttggctggatcaggagttcaacgacggtatggcgaaaatgttcggcatctcttcctgggacgatctgctggacgggccgaaaaaagcgattctgccaagttcagccgcctggtacgatcgcaagttcaaaacgccgtcaggcaagtatgaatttaaatctgaactggcggagaaaaacggccacaccgcgctgccggaatacaaaccggaagccgagagcaaactgccgttccatctgtttacgccgcacgtgcagtttggcctgcactcgcagtttatcaacctggactggatgcaggtgttctacccggaaccgttcgtttatatccatccttcttccgcgaagaaaaagggcatcagcgagaacgatctggtcaaagttttcaatggcaccggtgaagttgagctgcgggcaaaagtcaccaccaacgtgccggaagattttctggtgatgtatgaagcgtggttcccgaaacggcagtacaacgtgcaaaacgtcgtggccgatacgcctgctgatatggggctgatgaaaactggcgcgccgggcgccgctatccacagtcagtttgctgacgttgtattgatcggtaaaggggaatccgtagcatgagacgtgcgtttttagtgaatagcgataagtgcatcggctgccgcggctgtgctatggcgtgtaaaagctttaaccaactggagccggatcgcttctggcgctacgtttatccgttggataaagacatctatccacatgaagagcgggcgttttactcgctggcctgtaaccactgcgaacatccggcctgcgtcgccgcctgtccggtcgaagcctataccaaacgtgaagatggcgtggtggtgcataaccctgagcgctgcatcggctgtaaaaactgtattcgtaactgtccttatggcgcgccgcgttttaatgaagagacgcgtaaagcggaaaaatgcagtatgtgctacgagcgtcttgatatcggtatgaatccggcgtgcgtaaacgcctgtccggtgggcgccttgtcgattatcgatttggatgccgatcctgtgcccgataatgcggtgcagtatccgccagggttcccgcatatgccacagcttaatccaggaacgcgctttattctggcgcgccagcctaagcagccggaggacaagtaatggaaaaatatgaactgccgctggtgttttttacggtattaagccagatgtctgtcgggatggctttggtactgacatggcgtacgctgcgtggtgaagtggaaggccagcgtttctattggttggccaccgggctggtgctggcattggcgtctattgccgcgattctgcatctggcgcatcccgatcgcgcttatgatgcgctgattaacctgcgacatgcctggttaagtcgggaaatcctgggcgccacgttgtttggcgcagcggtcggcgtaacgttcctggcaaagggacataaagcgatggctcttatcgcctccgtgttcggcgtgttactggtggcggtgcaggggatgacctacgccgcgccagcgatggtggctatcgctaatggatttaccatgctgttattttttattacggtatgggtcatgggttgcgcggcgattccgctgttaaaactcaggcctgccgttcctgcgttacgccaggggattgtggtgtgtatcgcggtacttatcgcggcgccgctggtgtggttaagcgggggaacggtaatgcagatgacggcgcgttcatggctggcttcaccgttttatctggcaagcctggtctgccttgcgctcgcttttgtcgccagccgtcacggtgattcgcgcccgaaacgcctgttcgtcttgttattcgtcggcgtatttctgagtcggctggtcttttttggcgacacggtgagtactattgtgaatatcgggcatttgtactaacgatgatgcagtaaaaagccctgccaggcgtgacctggcagggcgtgtaagtttttagccaccagagttaacgcacaaccaatacgggcagcgtcgcatggcgcaccacgcttgaggcgttagaccccaacaggtgtgtcgtgatggacggattacgcgaaccgattaccacgacatccgcatccagttcttcgcccatctcattgacgacatcgcgcacgctaccaaagcgaacatgcgttttaattcgtgaaggatcgatactgaagtgtcccaccatcgtttgcagacgcgtttccgcctcatgctgtaaatgttcttcaaagcgacgcacgtcggcggcaaagcggtgcagactcatgctcgcggacccaggcagtacatgcaacagatgaatgacgccatcctgttgcgccagaaactcagcgtggcgaatggctttatcgctaagttccatttcaaaaacatcaaccggcataatgattgtcttatacatacccgttactccctgttaatcaatactgaatttattcaagcatataataatgtttctttctgctatttgtctggcaattttaaatattacggcaacctgatgttaaaaaagttgtgtattttccaggaaaaatcctaaagccgcctgttttgccggcagtctctccgggatagctacccttttatagtcgaacgtgacattcaccgttaccccggaggctgcatgaaagcattgacgtatcacggtccacatcacgtaaaggttgaaaacgtacccgatcccggcattgagcagcctgacgatatcattttgcgtgttaccgccaccgcgatttgcggatctgatttgcatctctatcgcggcaagatcccacaggtaaaacatggtgatattttcggccatgaatttatgggcgaggtggtggaaaccggacatgatgtgaagaatattcggaaaggggatcgggtcgttatcccgtttgtcattgcctgtggtgactgttttttctgtcggctacagcaatattcagcgtgtgaaaacactaacgacggacacggcgcggcgatgaataaaaaacagatcccgccaccggcggcgctgtttgggtatagccatctgtatggcggcgttcccggcggacaggccgaatatgttcgcgtgccaaaaggtaatgtcggtccatttaaggtgccgccgctgttatctgacgataaagcgctgtttctttctgatattttgcctaccgcctggcaggcggcaaaaaatgcccagattcagcaaggtttcagcgtggcggtttttggcgcagggccggtaggattactgactatcgcctgtgcgcgactgctgggcgcggagcagatcttcgtcgttgatcaccacgcctggcgcctgcgtttcgccgaagaacgttacggcgcgataccgatcaacttcgatgatgagaacgatccggcggaaaaaatcatcgagcagacggcaggacaccgcggcgtggacgcggtaattgatgccgtaggctttgaagcgaaaggcagcttgacggagacggtgctgacgaaccttaaactggaaggcagcagcggcaaagcgctgcgacaatgtatcgcggcggtcagacgcggcggcgtggtcagcgtgcccggcgtgtatgccggttttattcacggctttttattcggcgacgcctttgataaggggctaacttttaaaatgggtcaaacccatgttcacgcgtggctgggggaattattaccgcttattgaaaaagggttgctgaagccggaggagattgtcacgcactatatgccgtttgaagaggcggcgcgcggctacgaaattttcgaaaaacgcgaagaagagtgccggaaggttatcctggtgccgggagcgacgtcggcacaagcggcgcagaaacaggcgacgggagtagtcaacccgatgccaggcggcgttgtctgaagcaggcagaaatgaaagggctaacggaaagaggatgcgcaggcatcctctgtgtaaacgcattaacgcttatgcagatgatttaacgcaggaagtcgcccgcggcttcaggctgatattcgagttccagcacttcgagatgggtggaggcgccgcccggcagttcccagtgaatggtgtcgccgacgcgcagtcccagcaacgccgcgccgacgggcgccattaccgaaagctgggtactgctgtccgtcatattggcggggtacaccagcgtccgcacgcgtgtttcaccatcgctcaaattgcggaatttaacgcggctgttcatggtgacgacatcgttcggcatctcttgtggcgaacacatttgcgcgcgatccagttcggcgttgagcgcgtcggcaatcggcagatccgcatacgcaggctgttccagaagacgatcaatacgttcggcgtcaaggtcgttaatgataatagtgggtctggacatttcttactccatgtcatcgatactgcgagtagtgcaggtaaatggtcccaaaagaaaaccctcaccgtctggcggcgagggtttaactctcatgatgatactgagacttaccccgtctttgaagtgatttagttcacattcgggtaaatcctcaaacgtcatagccctgagtgaattttagtctacattcgggcgtgttctcaaatgtggctacggttttaaacctctgcttcgtcaataaccggctttatcgataataaactgtttcccgcagttgccgggatgcggctgcggcaggaatgaggcagaggagagcggggcgttaatcatcgacgcctttaatgaaaactgaatctctgttaaataggcgggattgccatggcagtttactttaacggctttgacattatcctggccccacatttgtgcgacgacgctatcaaactcagcgcggctaacggttttgccgtaattatccgtcagaaactgccccagtgcgctgtcttttatcgccttatccagccgtatcatggtgccgaaataggcattgggatcaaacccgaaacaggcgccatgtttggcatattcgtagcgctccagacaggaattcccccccgcgccgggcatcacttccttaagcgctgccgcgatgtcaggcgaaagtccgggggcggaggctgagcatttccggctggccttgacttcaggcagattcgggattggccgcgtcgcacaaccaaagcgctgccagcgtctctggtcaacaccgcgtgcggcgatagatttgggtaatcctggccacaggccgtggacggtcagaaagtctgctttgttggctggctctttttgcagacggcactcatcgggctcccgatggcggcgttcatgctggctttgacaaaaaccggtttgccaggaaagcgccagcacatagtcagtgaaatcaccgtactgttgcgcctgaagttcgtcggcgttggcggcaaaaatcggggttaagagggcagccagcagcggactgtaatgccatattgtgttcatgatgaattcgataatttatacacattatgaatgttacccatttaatcataaaaaatgccgctcaggtgaacctgaacggcatcatttttaacctgcgttggcgtaatgtttaattccacattgccaaaatcggccagcccaccagcaacagcatcgcgatatagataacgccaaagattgcgccaagccgccagtagtctctggatttcacgtaaccgcagccgtagataatcacaccagggccggtggcatacggcgtcagacagcccatgataccgatagacagcaccagcagaatacacagttgttccatcggaacgcccggaatgcctttacccaccgccagaatgaccggcagcatggtcgcggtgtgagcggaaagactggcgaacagatagtgcgcgaaatagaacaccagtaccagtacaatcacggttgcatccggagagaaaccttccagatgcgtactcatggtattggcgaaccagtcaataaagccggagcgggttaagccattggccatgaccaccagcgtagcgaggttcaccagggtgttccaggcgctgttgtagcgcgtaatatctttccacggcacaacatgcaacgccagcatcagcgagacggccagcagacccacggcagtggcgttgatgatttttccaccaaaaacccacaatcctaagctaagcagcaccaggccaatcagcgtccactctttgcgggacagacgccccatgttttttaactcgccgccagcccaggccgcgacttccgcactgtgggtcacttcaggtttataaagtacataggagagccacggcgcaacgatcagtaaaataatccctaccggcagaaagctgagaaaccactgcagccagctaatctggacgccagcgatcttgctgacgaactccagacctaatacgttcggggccgcgccagtgacaaacatcgaagagctcaggctggtactgatcaccatcatccacatcaaataaccgccgatgcggcgtgcggaaggatcgtttggaaacgatttaaacagcggcggcaggttcttgatgaccgggaagacagtcccgccggtacgagccgtattggagggagtaaacggcgccagcaaaatatcgataatgacaatcgcatagccgagcgtcagcgtgcgtttacccatgaattttaccaaaaacagcgcaatgcggcgccccagcccggtcacttcgtagcccagcgcgaaaataaacgcgccgaaaaccagccagaccgtggtgctggagaaaccggcaagcccccatttcagcgcctgtttactggctttaaacgccggatcggccagttctgaagcgtcaaatagcaggtaattgctgccgataacgcaaatggttacggcgataaaactgatcgctgtcgccgggatcggctccaggatcataccgacaatcatcgcgacgaaaaccgcaaaatagtgccaggcctgcggcggcataccatctggaacaggaattaacaacatgacgcccatcaccactaatggggccaacaacttccatatattatctttggataaagacataaatgactctccggaaaggatattttctataattgtgttaatgattaacttgcgaaatttgcgctaaaaaccaggtcacgatcagcagatcggcgctaccgcctgggctgagattgcgttcaatgcattgctgatcgaaccggtggagataaacgagatcgtcaggcgtccgtatgccgccctgctgtaataagaccgcagcctgctgctgtaaccagcgcagaccgtccgccccgccgcgcgacgcgacgttggtatcgccgttaagcgacatcagcagcagtaaggtatcaagcagcgccagttcgggatcgcgcccctgcgccagcaatgcgcggtagtgcggcaacgcgtggcggatgaccagcggatagcccgcttccgcttcaccgcgcgcgccggttaatcccagttgctgatacagccgctggcctgcggtgagctgtaggttgttctggcgcagttcgcgcgttgtcaggccgcggcaaaaatcggcggcggtagcgcagagtgtttctgcggcgatcggctggcgtagctgatacaggcggccaatggcggcgcacagtaaccccagcgagaaaatgctgcctttatgggtattgacgcccgccgttgcgcgaaacatcgctgcttcacaggccatccccaatggacgcaggcccgccagaactgactctggcggcaggcgcgtgcagctggcgccatattccataaagcgcggcagccagtgtcgaatcgcctccgcgctgcggtgaaaatccgccagcgccatatctttgtgcgcgccgcagtttagtcggtctaccagaccgggttttggcgataaatttacctcggtcagcatggcgcgccaggccaaatcggcccagacgtcatacagcgactgaggctgaatggaggcgttagtcgggttggcgggaatcggcatcatgcagcagcgcctccatatgaatcagtaaatcagtcagcgcgtgggttttaccccgcgcgcattcagccgcgctttgcccgcacagcagacagcggcgagcgggaagcgcgaaatggcggcgggagagtatttcgccttccgccgtcaggacatcgatatcccacaggcgccccagtggataacgctgttcaagcgcgatggtcgcctgtttgagcgcctgagcgggcgcgtcaatcgccagcagcccttccggcccgctggcggaagccagtgcagcctgctcccggatagtccagccatactcttctgccagcgtgtgcagggcagtcacgccgtgattaaagatccggcgggttaacgcgctgtcttttatcgggcctggcgccaccacggtaaaggagaccagtggagtggcgtggcgcgttagccaggcgcgctgtcttgcttgtctctcatcccggctggcgagcagctcaggaatagaaacgtcgtgacaggtggcgagttcaggaaacaggcgcatggcttattccttcacctgatgcaccacatcgatcactgaaccgtcgcgataacgcacgacagcaatcacgcggtcggtgaattcgatagggcggggctgaccggtaagcagttgcgcgcgttcgcgcagccactcaatcgataccactttcattcccgctgctttcaggcgttcagccagctccggacgcgccggattgacggcgataccgtgatcggtgaccagaatgtcgacgctggagcccggtgtgacgcaggtggtgacgttatcaaccagcgttgggatgcgaccgcgtaccagcggcgcgacgatgatggacagcgccgccgcgacggcggtatcgcagtgaccgccggacgcgccgcgtagaacgccgtcggagccggtcagcacgttaacattgaagtgggtgtctacttccagcgcgctcagtaccaccacgtccagacggtcgacggaagcgcctttagagccccagttggcgtactggttagcgctgatttcgatatggttcgggttgcgagccaaagattgcgcagcgttacgatcgaagctctgaacgtcaagcagtttgcggattaagcccttttcatgcaggtcgaccatggtggcggtgataccgcccagcgcgaaattagccacaatgttgcggctacgcattttgtcttccaggaagcgggtgaccgccagcgatgcaccgccggtgccagtttgtagggagaaaccttcgttgaagtagccggagtgagcaatgacttccgccgcgctgcgggcgatcagcagttcacgcggattagtggtcatgcgggtcgcgccagcgccgattttgtttgcatcaccgacttcttcgatttgcacgatcagatcaacctgatcctgagcgatgcttgccgggttatgcggatacggcagcagttgctccgtcagcatcacgacctgcttcgcgctgtcggcatccaccatcgcgtagcccagtgaaccgcaacaggctttgccggtataaccgttagcattaccgaattcatcgcaggagggcacgccaagaaatgcaacatcaatattgagttcgccgctttgtaccagatgtacacgaccgccgtgggagtgaatctgaaccggctcagccagcaagccgcgagaaatttcttccgccagcgggccgcgcaggcctgacgtgtagatgcggctgaccaccccgttacgaatgtgttcaaccagcggcgcatggcagtcgctcagcgaactggaggccagcgtcaggtttttgaagcccatcttcgcgatggtttccatcaccaggttaatcgtcagatcgccgccgcgaaacgcgtggtgaaaggagaccgtcatgccgtcgcgtaaaccggaacggcggatggcctcttccaggctggcgcacagtttgtggtcgcgcggtttttgcgcttgtagatccaattttgccgcactttggtaagcgctcagttcgctttcagcgtgacggctccaggctgctacgcgatcctggcgttgagattcatttttctgcgtcatttttttgccttattcttcgcgaataccggaaagttctgcacgggagagcaccagacgggcgcgttcaatcaccgggctgtcgaccatcttgccgttaagggaaacgacgccgagaccttcgcgggcggcggcttctgcggcttcaacgaccagacgcgcatgggcgacctctttacgcgttggcgcataaaggttgtgcagcagttcgatctggcgggggttgatcagtgacttaccgtcaaagcccaactgtttaatgtgggcggcttcttgcaggaaaccggcttcgttgttggcgtcggaatagacggtatcgaaggcctgaatgccggcggaacgcgcggcctgcaaaatggcgcagcgggcgaacagcagttcggtgccttccggagagcgttcggtgcgcaggttgcgaacatagtcttccgcgcccagcgcaatcccgatcaaccgttcagaggcgtgggcgatttctaccgcgcgggtaatacccagcggcgattccacggcggctaacaggccggtactgcccggttcgcgaccgcaggcgttttcaatgcgcagaatttcgttttcgatatcaatgacgtcctgcgcggtgtcggttttcggtaaacgcaccacgtccgcgccgccgcgcacgaccgcttccagatcgttgacgccccattcggaatccagcgcattcacgcggacaatggtttcgacgtcacggtaaagcgggtgttgcagcgcgtgatataccagacggcgcgccgcgtctttttcgcgtaatgcaacggagtcttccaggtcgaacatcagcgcgtcggccgggtagataaacgaattgctcaccatcgccgcgttggcgcccggtacgaataacatactgcggcgggtgcgggttttacgttgttgcagagaggcggaaatcattggcgatcctcccagggcagagcggcaataccgctggcgcgcgccagtagcgtttccagtcgggcgcgcaaaatgcagtccagagcgcctttatcatcgacgttcagttgtacgccgcgcacgtcgtagcgagaaagcacctccaggatggtggcgcgaatggcctcgccaaactgtttttcaacgctactgttgatttgcaggtcaatatcctgcgtatcgagcggcgcaatgcgtatcatcacatcgccggactcaagcgtgcctgcgacggctagctggtttattttcatttttcacctgttgctaatacgggggacttttgacgggctgccgcgctgcccggatggcgttcgaccatgccctgcaaatagcgcagggtggcgtcgggaaccagcggcgcgatagccgtgagatcgtgtttaaccagcagcttgcgtacccaggaggcggatatcggcgtctcctggaagcaaagccgctctatttccaccagcgtaatgggtggggcgggaagcgttggcgtctccagccagaaacgcatatcaaggttgtactgggcggtaacggtgcaaaacggctccgtaccgacaaagcggtgtgtgatgccaagcgcgggcgccagatactggcggaaaatcttcaggtcgatttcggtataacagtgattaataacgctctgctctttaatgaaatagcaggggaacgtcgcacgagaaataatgtattcggagccgcggtgaacggttaagcgcgggatatcggtggtccctttaaggaccagatcgagtcggtcttcatagggaaagcgtgatgtatcttctttgaccaggaacagatgcagccagtcgcactgtgccgccgcctgttggatcagatagcgatggccgttcgtgaaaggattggcgttcatcacaatacagccaattttctttccctcatgacgcaatgtcgccagcgattccgcataccgtttcaaccgggtcgcgctattttccattaagaccattacgccagggacgctggctatcgtcgaaaagctgcactgtttaaacagcgcttcgtattccgttttggtataaataaaaagatgggtgcagtgccgctcccaggcgagattaatcaattccgtcgccagcgttaacgctaagccttcgccgcgtactgattcgctaatggccacgcatttaatgatatttccggcaataccgccgcaggcaataagacggtcatcacggctgacggtaataaacacttctacagtggtatcgacgcttaaatcattctctttgagaaagtgagcgatctccgccatttttttattttcagagcgttttacccgagtgaatacattattgccaaacatagtaagaaatatcctggtgatatgcttgttgccacttttctgtatatgttgcgctgtgttgcaacttgataactttttcttttcagtcagagtaggagtttttttatgacgagttatttatttttctctctgacgtatacatcgtaaggagtattttggtggtaaattttgatttatttcacaaagcgttagatggtttttaagtgttttatggttttaagttttttaattaatttaatcgccattccggcggtgggttttagttgtttaattgatttaatgtggggaatctgtaacgattggtttttatatgcttcaagatgctcaaaacatttttattacatttgcgataaatctgaagagaaatgcccataaggaaccttaatgtcctgtcagaaaaataaaaagctgtttcctttttttcggcaactcgcgtttccgttacgtatttttctgctcattctggtggtttctgttttcatcgtggcagcgttagcacaatatttgtctgccagtttcgaagattatctggcgtcccatgttcgtgatatggcgatgaatcaggcaaaaattattgcttctaacgacagcattatcgctgccgtaaaaaaccgggactataaacgcctggcgataattgcgaataaactgcagcgcgggacggattttgactatgtggtgataggcgatcgccactcgatccggctttaccatccgaatccggaaaaaatcggctatcccatgcagtttacgaaacccggcgcgctggaaagaggagaaagttatttcattaccggtaagggctcaatagggatggcgatgcgcgccaaaacgcctatctttgacaacgaaggcaacgtgatcggcgttgtttcaattggctatctggtcagtaaaatcgactcctggcggctggacttcttattaccgatggcgggggtttttgtcctgttgctggtggtattaatgctgctttcctggtttttcgccgcgcatatccgccgacaaatgctgggcatggagccgaaacagattgcgcgcgtggtacgccagcaggaggcgttatttagctcggtttatgaagggctgatcgccgttgatccggagggacatatcaccgcgattaaccgcaatgcgagaaaaatgttggggctgccgtcgccggggcgtcagtggctgggcaagctgatagcggaagtcgtcaatccggcagacttttttacctgccagatcgcagaaagacgccaggacgtgatggccaacttcaatggcctgagcgtcatcgccaatcgtgaggctatccgttccggcgaggagctgctgggcgctattattagttttcgcagcaaagatgaaatcgcgacgttgaacgcgcagctaacccagattaaacagtatgttgagagcctgcgcacgctacgccatgagcacctgaactggatgtcgactctgaacggcctgctgcaaatgaaagagtatgatcgggtcagagagatggtgcagggtgagtcgcaggcgcagcagcaacttattgatagtttacgcggcgccttcgccgatcgtcaggtggccggtttgctgtttggcaaagttcagcgcgcgcgtgaactggggctcaagatggtgattgttcccggcagccagctacatcaactgccggaggggctggatagcacggagttcgccgccatcgtcgggaatctgctggataacgcgtttgaggcgagtttacgtacacaggaaggcgacaagaccatcgaacttttcctgagcgacgagggcgacgaggtggtaatagaggtcgccgaccagggctgcggcgttcctgaagcgctgcgggaaaaaatttttgaacagggcgtaagtacccgaaccgacgaacccggtgagcatggtatcgggttatatctgattgcaagttatgtggggcgctgtggcggggtcattacgctggaagacaatgatccttgtggcaccttattttctttattccttccgaaagtgaaaaaaaacgatgacagaaccattaaccctattgatcgttgaggatgaaacgctgctggcggagatgcacgcagaatatatccgccatattcctagctttaaccagatatggctggcgggcaatctggcgcaggcgagaatgatgattgaccggttcaaacctggattaattctgttggataattatctgccggatgggaaggggattacgctgctgcatgaattaatgcagtcgcgctatcccggcggcgtcgtgtttacgaccgccgccagtgacatggagacggtagcggaagcggtacgcagcggcgcgtttgattatctggtcaaacctattgcttatgagcgtttggggcagacgctgacccgctatcaacagcgcagacgtatgctggcgagcgcggatagcgcaagccagaagcagatagatgaaatgttcaacgcctatgcgcgcggcgaaccgaaaggggatttgccgaccggtattgatgccttaacccttaatgcggtgatgaggctgtttgccgatccaaccgtacgccatacggctgaaacggtcgcgcaggccttaacgataagccgcaccacatcccgacgctacctggaatattgcgcgagtcagcatctgattgtcgcagagattattcatggcaaagtgggcaggccgcagcgtatttaccacggcggctaagcctggtttaagatgccggggcgatgttttccctcgccccggcttaccggctatcagccgccagtaacgctggaagaggcgcctggcaccataatttccgtggcgataatgacgatcaacagaccgacgataaccggaacggacgtgcgcttcaccacttcaaacggtgatattttagccatcccggcgacagcgaccacgacgccggagaccggcgaaatcgtgcgccccaggtttgaggcttgcagcattgggatggataaataggctgggttgataccggaggagtgcgccagtttagggatcatctcaacaaaggcgtaaaaaggcgcattgcctgaaccggtggtcatcgcggccagcatggttaaaatcactaagaccagcatcagaataatgctggcggagccaaaagaagtggcaatcgagatcagactttggataaagccaatggtgctcagcccctgggcgaaaacgcccgccgcgaccaacagcatcacaacgccggcaaacgcatccgccatgccgcgataagccacttccaggccggaaaacacattttgcgtgttgaaaccgcgcacgaattccagcacggcggccagcagcatacagatcaccagaatggtaataatgtgcaactgcggcccccatttaccgtcaaaaatcagtacgccgataatgggcgtgaacggcaaaagggcataaaacgccggggccgtggtggtaatctccgccacgtccagcatctcatgtgaaatgttctcttttttatccagatagcgttgccagaaaaagtgcgcaatcgccataccgataatggcggcgatggaaattggcagcgtagttttgaacgcgaaatcgattaacggcatctccgccgcttttgcggctaaaaccacatcgccagacgttggcgagaggatgatggcggccggagaggcgcaaatagccgccgccgcgccgcggctaatgccgacgttgaccatcaccgggaagagagtagccatgagcagtacgccaagccccgtcgcggaagagacggccagcgacatcaggcaggcgacaaaataggcggcaatcatcaacaggtagggcgagtttatgtactgtaaaggtttcgacgccagcttcacgaccatatcattcgcgccgatatgcgtcatataggcggcaaagccgcacagcatcatgatcatcatgccaagatcgccgccgcgactcataagcaaaattttgatgtattcaacaatatctgttgcggtatagccggtactggtttcgctggcaggtaataccttatgccccatcagcgcgctgataataagcagagccagaccgccgacaaataaaacgccagtggcggaatatcccttaatgatgtagcgcgctacacccacaataacgacgactccgataaggagctctataactgttagcattgtttcccctgtcttatcgacacccagagtaaaaataagaaccacaaaagtggtataaaaatgtaccgaataaaggatggcgccttactgattaaaatcacggcgcggttattttttcatgtcattgctaaagatgaaatatacttatacgaattttctgtagcactataagtattaatttattgttattttattgttttatttgttgtgctttgttttgtgttttttgtgaaagcttattaaggagcgcgtgacggttctgagtgctaaatcaaacgccgttaacccgatactctctcagattattctctgtttatagtttgttaagattttattcaggttaatgttgttattatcacagtcgaatttttgaacggtatgtatgttgcgatgatcatcagaaagtattttcttattattgctctccttttgatgccatggctggctattccttcagtctctgcggcggataaaggggggtttaacacgtttaccgataacgtcgcagaaacgtggcgacagcctgagcattatgatttgtatgtccccgccattacctggcatgcgcgctttgcctacgataaagagaaaacggatcgctataacgagcggccgtggggcgttggttttggtcagtcccgctgggacgacaaaggcaactggcatggcctctatatgatggcctttaaagattcatttaacaaatgggaacccataggcggttatggctgggaaaaaacctggcgaccgctggaagacgataattttcgccttggactgggctttaccgcaggcgttaccgcgcgcgacaactggaattatattcccatccctgtgctgttgcctttagcgtcgataggctatggtcccgctacctttcagatgacctacattccgggttcgtataacaacggaaacgtctatttcgcctggatgcgtttccagttttgatggggaagggtatgcttcagttgtgaattaaaaagtcttaaaaaacaataagtagatagagttagctaaaaattaacgcgatatttatcactttttcgcaaagttcgactggacaaaatgcatcacaattgttgtactggtatccgacacagcatttgtgtctatttttcatgtaaaggtaattttgatgtctaagattaaaggtaacgttaagtggtttaatgaatccaaaggattcggtttcattactccggaagatggcagcaaagacgtgtttgtacacttctctgcaatccagaccaatggttttaaaactctggctgaaggtcagcgcgtagagttcgaaatcactaacggtgccaaaggcccttccgctgcaaacgtaactgctctgtaagcatacgtccgacagcaagatttcaaaacccgccctttcggcgggttttttttgcgcttaacgcgccgctgcggcggaaaatagccagaatgccagcgccgtcatggcaaacgaacctaacaggttaatcagcacattcagcagcgcccagccaaagcgcccctcttgcagcaagaataccacttcggcagaaaaagtagaaaaggtcgtcaggccgccgcaaaagccggttgtgatgagcactttccacatcggatcgatatgtgtcatgcggttaaaccaggcgaaccccatgccgataataaacgcgccaagcaaatttgctgttagcgtaccgatgggaatcgcctgatgaagcggattaaaacgcatactgagcatccaccgggctacgctccccgttccaccgccgataaaaactgctaaaagaagctgtaacactgccgaatcctttatttaattgctatacaagaggagtgtaacgccgaacacgcataattggcgagtcctgacagaggtgtgggaggggatatgttcgttgcagccgggcagtttgtggtgagttctgtatgggaagagaatgcgcaagtttgcgtttcgttaatggctcaggcggcgggccgcggcgtatcgcttctggtgttgcctgaggggatattagcgcgagatgacatcgaccttgacctgccgattcgcgccgcgcagccgctggatggcgcgtttatgacgcggcttctggaagaaagcgctcataataatatgacgacgatattcactatccttgtcccgtcaacgcctggacgggcggttaatatgctggtggcgctacgggcgggtcacattgtcgcgcgttacgcgaagctgcatctctatgatgcgttttcgatgcaagaatcccaaagtattgatgccggaaccgttatcgcgcctgtgctggacgtggagggggttaaggtggggcttatgacctgttatgacctgcgctttccggacatggcgctagcgctggctttacagggggctgacgtattggcgctgccgacgggctgggttcgcggcccgttgaaagagcagcagtggtcgacgctgctggcggcgagagcgctggataccaccagctatatgattgcggccggggagtgtggtaatcgtaatattggtcaaagtcgtattatcgatccgttgggggtaacgatagccgcggcagccgatcgtccggcgctgatcgtcgcggaaatattcagagaacgaatagaccaggtgcgggagcaacttcctcttttgcagcaacgacgatttgcgccaccgcaattattatgatgtttttttacgcaaagcttgattcaccttgttacagattgctattgtgtgcgcgcgtcgaaagaccgttaatattctcaggttaatccggcgcgttacgcagcctgtttttagtgaagaaggtatctatgggtgagattagtattaccaaactgctggtggttgccgcactggttgttctgctgtttggtaccaagaagttacgtacgctgggcggagacctgggcacggcgattaaaggattcaagaaagcaatgaacgatgaagacgcgggcgttaagaaagacgtcgacggtagcgttcaggctgaaaaactctcgcacaaagagtaattgcgcgatgcgcttgctccgcagagtaaaaaaaccggcgagttgccggttttttttgcctgaaatgtaagcgtctattacacgatcatttcacttccatgcctttggcctggagatcagcatggtacgaagaacgtacaaaggggccacaggcggcatgggtaaagcccatcgccagggcttccgctttcatctcgtcaaactcttccgggctgacataacgctgtaccggcaggtgatggcggcttggctgtagatactgaccaagcgtcagcatggtaacgccgtgacggcgtaagtcgcgcataacctcaatgatttccgcattggtttcgcctaagcccaccatcagacccgattttgtcggaatttccgggtgcgcttctttgaagcgttccagtaatttcagcgaccagttgtaatcggcgcccggacgaacctggcggtaaatacgcggcacgttttccaggttgtggttaaacacatccggcggcgtcgcgttaaggatatccagcgcgcgatccatacgtccacggaagtctggcaccagggtctctatttttatctccgggcttttggcacggatggcggtgatgcagtcagcaaaatgctgggcgccgccgtcacgcagatcgtcacggtcgacagaggtgatgaccacatagcgtagcgccatgtcggcgatcgtttgcgccagtttctgcggctcttccgcatccggcgcaacggggcggccatgggcgacatcacagaacggacagcggcgagtgcaaatggccccaaggatcataaacgtagcggtaccgtggttgaaacattcagccaggtttgggcaagatgcttcctcgcagacagaatgcaggccatttttgcgcattgcggctttgatgccctggatacgggtagaatccgccggaagttttattttcatccattccggtttacgtagtagagcgtcgcgctctgtgaccacatttttaaccgggataagagccatcttatcggcatcgcggtattttacaccgcgttccatcacaatgggtttactcatagcgtgcgtgttccagttgcgaataacgaaggaaagcgtttcaattcaagggaaagttgtatttatcaactatttttgaatttgtgacacgcagtatatcattgataagggccataaagcagcctgacagcccggcaaaatgtaaaatagttgttgttttgtgctgtttgcccatatcttccgtgacctgaatgcaacatttttgtcagaacgcctcacggatgatatcaatgacgttctccagcaccggatcgcgcagactcagtttattgtaatgcagcgagaactcgacctgttcactattcaccggcgcgtagggaaggcgctcaagcggccagcagcggctaaataagtcgtagaagcgggtgggcatcagtcccagcagatcgctgctggcgatcagcgaggcaatggtaaaaatattgtagctgctaaaactgatttgctgatcgggaaatgtctcctgcagtcgctggcgcagcagggaaagatgttgtccctccagcatcagaaaggtgtgatccgcgctgttcagtctctcttcagtaatggcgttcgccagacacgggtgatgctggcggcagacaatctcaagcgtatcgctaaacaggacgtgatgctggatgctccggttgttatagctatgggtattgataatgagatcggtctgaaactgactaagctggctttcggcatcgtctaccggaatgttgcgcagcaaaagctgaggataacgcggcctgatggcctggtaaataatcggcatcactagcgcgccgaccgaaggcgtcgtgccaattgtaatggtgcgttgcttatcatagctgcccgtaagatccagggcgccaagaatagattccagcccctggctgatgtattcgtgcagatgcgtagcatacgtcgtgggcgttacgccctggcctttgcgaataaacagcggatcgggaaatatagtccgtaatttttgaatggactggctaatggctgacggcgtcaggttaagaattttcgctgcattgacgatccctttatggacatatacggcctcgaaaatcgtcaacagattgaggtcaatatttctcagtgttctgaaaatttgcggtttgtcctgtaggtgttgatcggccggttgtctttctgcctgattattatcactcacgctctggctccgaattcattcgtattatgaataatagatgaaatagtatattttgcatttatgggttggttttaaaattactcttatgaatgtatttttagtcatttcaataagataagtaacagcaaggccgggattttgttcacggaaaattcctcatcatgaggactgaagaggccatgccgcctggcggctacagcagggatataacgaaaatatagaaagcggggggagaagtaaagcattcaaatcatatatgattaatgacccataaatttcttgggccattatattttacgcattaagcagcaatatattcatacggtggattatttagcagagctaaaatattcgccagcaagcggggcgcaatattatccgtggtagcatcttccttccactgcgttattttggccatttccatgccggcataaccacacgggttgatacgcaggaaaggagaaagatccatgttaacgtttagcgctaaaccgtggaatgagcagccgcgacggatacgtaaacccagcgagcagattttcttttcacccacgtagacgcccggcgcatcggcgcgcggatgcgcctcaataccaatttcagccagcgtattcaccacggtctgttcaagtagggtgactaaatcacgcacgcccagtttacgtcgtttcaggttaagtaaaacgtacattacctgttggcccggaccatgataggtcacctgtcctccacgatcgctctgcacaacgggaatatcgccaggcatcaatatatgttccgctttaccggcctggccctgggtaaacaccgggtaatgctcaaccaaccagatttcatcatggctgttttcatcgcgcatatcggtaaagttatgcatggcctgagagatagcttcatagggctgaaggccgagctggcggacaaggattttatcctgatacaaaacggcatctccgtagagaatgaaaaaagagaggaaagtatatcacagcgggggaggcggggagttacccggataagaccgggtaaccgtctggatgtattacaataccattcgcacgatatcaatattgcccagttcttcgtacagcgtttcaacctgttcaatatgggtggcattaatggtgatagagaccgagtggtagttgcctttgctgctcggttttaccgtcggagagtaatcaccaggcgcatggcgctgtaccacttcaaccacctgatcaaccagctcaggtaacgcctgccccattactttgtaagtaaatggcgtagggaattcaagcagttcgttaagtttggttttcatgtcagctccggcattacgtaaaaaaaataacaactcccgccacagggcgggagttttactgatgcatagtatatggggacgaaaatcacactttcaagcgttcaatttttatccaaaccagtgatggaacattaatttaatgtaatcaatgattttaccgaagaagttcccttccgggatctcttgcagtacgaccagcggacgctgctcgatggttttaccgtccagctggaagttgatggtgccgaccacctggtttttctgcagcggcgcgtgcagttctgcggtattcagtacatagctcgctttcaaatctttcatgcgaccgcgagggatcgtcaggtaaacgtctttatcgacgcccagcgaggcgcgatcggtattaccaaaccaggcgggttcagaggcgaactctttaccagccttcagcggattaacggtttcaaagaaacggaagccccacgtcagcagttttttgctttctgtttcacggcctttataggtccgtccgcccatcacggcggaaatcaatcgcatctggccttcggttgcggaagcgaccagattatagcccgctttgctggtatggccggttttgatgccgtccacattcaggctgttatcccacagcagaccgttacggtttaactggcgaatgccgttaaaggtgaactctttttctttataaacggcatattcgttcggcacatcgcgaattaacgcctgaccaatcagcgccatatcgcgagctgaactgtattgtccgtcggcgtccaggccgtgtacggtctggaagtgggtatttttcagccccaacgcgttcacatagctgttcatcagcccgacgaaagcatcctggctaccggcggcgaaatcagccatcgccacacaggcgtcattgccggattgcagattgatgccgcgtatcaactgagagaccggtacctgcattcccggcttgaggaacatcagcgaggagcctttaaataccggattgccggtggcccaggcgtcattaccgacggtaaccaggtcggtttctttaaatttacccgctttcattgcctgtccgatgacgtaactggtcatcatcttcgtcagactagccgggtcgcgacgttcgtcggcgttttgttccgccagaactttgccggagttgtagtcgatcaggatgtaggattccgcatcgatctgcggaacgcccgggatcatagttttgatattcaggtcatcggcatgtgcggttgagataaacgcggcacaaagcgccgtggtgagcgccatgcgctgcataaaacgagcggaaaaagtggtcttcatggtctgaactacgacgtccgtgatgaaattaaaaaaagagccctactatagcaaaagcataactggcaggcatctgactttccgcgtgactttgttaatgtcatttacagaaattgacagtacagatacctgcgatcggttactgcgcgctggcgataaaggactgtaattgtgcttctgtttgcaaacgttgctgtaacgcgctggcttcggctttactggcaaaaggccccagttgaatacgccagaccgcgccgttttgtattacgcgtcctggtacgctgaactgctggcttaaacgctgttggtattgctgcgcacgcgtttgatcgctgacggcgccgacctggacgacgaaacgaccgctcgccgcggcggctggcgcactcaccggggcagataccggggccgcggcagcaggcgcgcttaccggcgtcgcagtcgctggagccgtcgctggagccgccaccggcgcggaaaccggcgctggctgtggcgccggcgtcggttcattactctccagcacgccaggcgccagcgtagtcggcgcgccgaggaagccgctgctgctcaccggcgcaccggtggtatcgtcacttttcaacgtggaattactgaccggaagaacgtcgccttgcggttgtgcaggtgctgaagaggcgcttcccattccgccgcttaaatcagggcgcgggggcagagcgtaggtctgtttcgccaccgtcgtacaggccatccccgggccggagagcgaaccatccggcgccacgataatggggtcaatccgtactttagtattattcgaggtattcagacgatccgccgctgcgcgggacagggagatgacccgatcggtgccataggggccgcgatcgttaatacgcacgacgatcatgcgaccgttggccaggttggtgattcgcgcatagctggggataggcagtgtcggatgggcggcggtaagctgcatcggatcgaacatctccccggaggcggttaaattactgccgggttccgcatcataaatagcggccaggccagcctggctaaagcgggacgggtcctgaacgattttataacttttaccgtcacgctgataatcctggtttgcggtcggattcagaggttcataacgcggttccgctccgctgatttccacagtcggaccattacataccgcaggttgcggcgcgacggtggtttgctgctgaccgccgtcattagtacatgccgcgagtagtactatccctgccgcgacgcagattacaggcaactgcttacgcattgcgcaccccttatacgcttttcgacaacatttttctgtgggtgtggatcgacatcacaatcccgaacccggccatcagcacaatcagtgcggagcccccgtagctgaccaggggtaaaggtactccaaccacaggcagaataccgctcaccataccaatatttacgaagacataaacgaataatattaacattaatccgccagccatcacgcgaccaaatgtagtttgcgctctggcggcaatccacaagccgcgcattattagcaaaatatagagcgcgagcagaatcaggatgcccaccagaccgagctcttccgccagtaccgcgaagataaagtcggtatggcgttcgggtaaaaactccagctgcgactgggtgccgtggagccagcctttaccgcgcaggccgcctgagccaatggcgattttagactgaataatatgatagcccgcgcccagcggatcggtctccggatcaaggagcatcatgacgcgctggcgttggtaatcgtgcatcaggaaaaaccacaaaataggaataaatgcagcgatcaatacaatggcgaccccaattaagcgccagctcagaccagacaaaaataggacaaagagaccggaaagggcgaccagaatagacgtccccaggtccggctgggcggcgaccagcagggtaggcataaagattaataccagggcgatggcggtatttttcagcgagggcgggcagacgtcgcggttaataaagcgggcgaccatcagcggcacggcgattttggctatttccgaaggctgaaagcgaacgattcccagatcgagccagcgctgcgcgcctttggatattgcgccgaaggcatcaacggcgaccagcaaaatgatacaaatgatatagagatagggcgcccagccttcatacacgcgcggcgggatctgcgccatcaccaccatgaccaccagccccatcgcaatctgaccgattttacgctccatcatgccgatgtcctggccgctggcgctccagatgaccaacgcgctataaaccagtaacgccagcagaatgagtagcatcgtgggatcgatatgaattttatcccagaaggtttttttgttcggattatccgtcatgattattggtcctccgccgctgcaaccaccgggttttccgcaggcaaatgggtgttgttgtcgcccagcatgatgtgatcaaggatttggcgcatgatcgtgcctactgccgggcctgcgccgccgttttcaaggatgatcgcgacggcgacctgaggattgttatacggcgcaaaggcggtcatcaatttatggtcgcgcaggcgctcggcgattttatgcgcattgtacgtttcgttggccttcaggccaaagacctgcgcggtgcccgacttcgccgcgattttatagggcgcgctggcaaaatatttatgcgccgtgccgttagggcggttggcgacgccatacatgccatctttcgcaatttcccagtagccggagtgaatatcgcccaccggcggctcatgcggctgtacccacggcacctgtttaccgttttccgcggtgctcattaacaggtgcgggactttaactacaccgtcgttaataaggatcattagcgccttactcatctgaatcggcgtcgctgtccagtaaccctggccgatgcccaccggaatcgtatcgccctgataccacggttttttaaagcgtttctgtttccactcgcgggtcggcatattaccagagcgctcttctgcgagatcaattccggtgtagtgaccatagccgaacttacccatccattctgacaggcgatcgatccccatatcataggcaacctgatagaagaaggtatccgccgactcttcaagggatttggtgatattcagatgcccgtggccccattttttccagtcgcggtagcgtttctcagaccccggcaactgccaccagccagggtcgaaaagactggtgttacgggtgatgacgccagcgcttaacgccgatacggcgacgtaaggcttaacggtagaagcaggtgggtagacaccctgagtcgcgcggttcactaatggcgtgttcgggtcgttaagcagcccggaataatctttgctggagatgccatccacgaaaaggttagggtcgtaacttggcatggagaccagcgatagcacgccgccggtacgtggatcggtgacaatcaccgccgcgcgactgcctgccagcagcgtttcaatatactgctggagcttgagatccagcgtcaggtagatatcgtgtccggcctgcggcggcacctctttgagttggcgaataacgcgaccgcggttgttgacttcaacctcttcataaccggtttgcccatgcagaatatcttcatagtagcgctcaatgcccagcttgccgatgtcatgggtggcggcgtagttcgccagtttgttttctctgtcgagacgctcgacgtctttatcattgattttcgatacgtagccgataacgtgggtcagcgccgatccgtatggataatagcggcgtttatagcctttgacttcgacgcccggaaaacggtactggttgacagcaaagcgcgcgacctgaacttccgtcaggtttgttttcaccggaatagaagtaaagcgatgggatcgggcgcgctcttttttaaaggcggcgatatcgtcgtcgtttaaatcgaccacactgcgtagcgcatccagcgtttgctgaacgttatccaccttttccggcatcatttcaatctgatagatagtgcggttcagcgcaaggggaatgccgttacggtcgtagattatcccgcggcttggcgcaattggcaccagcttgatacggttttcgttcgagcgggtctggtaatcggtaaaacgaaggatttgcagattatacaaattggcgatcagtacgccggtcagcagcaaaatacccaaaaaggcgaccagcgcccgacgcacaaacagtgcggactcagccgtatagtcacgaaaagaattttgtcgtttcatccgctgcttaatcttctcaagacttcacgatcactcacggtgataagggtggttggttgtgatgctccacgcccggtacaaactctccgcaaccagaacccgaaccagcgggtgagggagcgttaacgccgagagcgaccagctctgttccgctgccgctttgcaggcgggagataatccttccgggccgccaatcagcaaactgacgtcgcgcccgtcctgtttccagcgctccagctcattggctaactgcggcgtatcccacggcttgcctggaatatccagggtaacaatgcgattcttaccggcggcggccagcatctgctcgccctctttgtcgagaatgcgtttgatatccgcgttcttgccgcgtttgcccgcagggatttcgatcagctcaaagggcatatctttcggaaaacgacgcagatattccgtaaatcccgtttgaacccagtcgggcatcttcgtgccgacagcgacaagttgcagcttcacgcattaactccagagtttttccagttcatacaggcggcgactttcttcctgcatgacatgcacaatcacatcgcccagatcgacgacaatccagtcagccgcattttcgccttcgacgcccaatggcagcataccggccgcgcgcgacgactgcaccacgtggtcggcaatagacataacgtgacggctggaggtgccggtacaaataatcatacagtcggtgatactggatttaccctgaacatctaaggcgatgatgtcctgacctttcaggtcatcaattttgtcgataacaaaatcctggagtgctttaccctgcaagttttccccctgggtgaataattgcgttataacgatagaaaaaaggccaacaggctggaccggtaaggcgttgcgagttaacgctaaccttccggcgggacgccgtgtagtatacctgaatcagcggcgataccgggacttatgtcgccggatcggcgtttaaaaccagattatcatcccatcccacgtcacagaaagcatcgccatttttgtaaaacaatttctgcaaagctctgcaaggtgaaaaaagcctggctgcggagaataacagcctgtcgggggctgtcaatgggcgaaaccgctgcggcgagaaaaaacggaaaattcatcactcaggccgccagacggcacgactatttaatactttcagggtggcgaacccttcgcatatgtcgattgcgctccagcatccctgttctacccggaaatgccatagcgaggcggcgggcattgtgagcagacgggcaatcaacaggctgagtacgccctgatggctgacgatcagcaggttctggcaatcgctaaacgcgtcgagtcgcgagataaagcgctctacgcgccgggtaaaagcctgaaaaccctcgccattggtcggaaccgcattctgccagtccgtacaccaggcggcatagctttcggcatcttcatgggtgaggtcgcggtgatggcgcatttcccagtcgccaaagtacatctcattaagctcaggtaagatgtgttgcggcacatcccggccctccagtacgagccgggcggtatggcgcgcgcgctccagctcgctgcataacacccggtcaaatggcgcgtggcgcaataaagtatgtagcgttttcgcctggccaatccctttttccgttaacggcgtgggagcatgtccgctatacaacccggcgacattggcctcggtttcgccatgacgcaccagccacaatcgcatggtattcctcatgaggttaaatgcgcaaaacatgataatgcccctgattgcgcaacgtttttttcactaaaatagcgttttttggctggaggcataatggcgttattcaacagcgcgcatggcggtaatattcgggaagccgcgacggtgttgggcatctcgcctgaccagttactggattttagcgcaaacattaatccgctgggtatgcctgtcagcgtgaaacgcgcgcttatcgacaatctggactgcattgagcgctacccggacgccgattattttcatttgcaccaggcgctggcgcgtcatcatcaggtgccggcatcgtggatactggcgggaaatggcgagacggagtcaatctttaccgtggcgagcggtcttaaaccgcgtcgtgcaatgattgtcacgccaggtttcgcggagtatggccgggcgctggcgcaaagtggctgtgaaattcgtcgctggtctctacgcgaagcggatggctggcagcttaccgatgccattcttgaggcgttgacgcccgatctggactgcctgtttctgtgtacgcctaataatcctaccggcctgctgccggagcggccgttattacaggccattgccgatcgctgcaaatcgctgaacattaacctgatcctggatgaagcgtttatcgattttattccgcatgagacgggctttattcctgctcttaaagataatccgcatatctgggtgctgcgttcgctgaccaaattttatgccattcccggcctgcggttgggatatctcgtcaatagcgatgacgcggcgatggcgcggatgcgtcgccaacaaatgccgtggtcggttaacgcgctggcggcgcttgccggtgaggtagcgttacaggatagcgcctggcaacaggcgacctggcattggttacgggaggagggcgcccggttttatcaggcgctttgtcagctccccctgctgacggtttatcccgggcgggcaaactatctgttgttacgctgtgagcgagaggatattgatctgcagcgacggttgctgacgcagcggattttaatccgtagctgcgctaactacccggggctggacagccgctattatcgtgtggcgatacgcagcgctgcgcaaaacgagcgtctgctggcggcgctgcgcaatgtgcttaccggtatagcccctgctgattgatgtagttcagcacgttttccggcaacagatcgtcgcaggattcgcctttttccagccgttcgcggatgagggttgcggagatattaagccagggcgtttccgccaggtaaattttaccggctggcaactggtgcagatcgtccggcgtatgggtcagatgctgttccagccactgctggtgttgcgcctgcgtcatttcaagggggtagccgggacgacgacaaacgatcaggtgagtgttatcaaggatggtgtcgtaatcatgccaggtggggaagttaagcagcgagtcctggccgataataaacgccagcggcgcttcggggccctgttcttcgcgccatgctttcagcgtttgcgcagtgtaagagggcgcgtttcgctgtagctcgcgttcatccagcgtaaaaagcggcttatcggcgatagccagctccagcatatatttacgctgcgcgctggaggcttccggctgggggcgatgcggcggcacattgttaggcataataatcacccgcgataagccgatcagattcgccagcgtttcaacaggtttaagatgtccataatgcaccggatcaaaggtgccgccgaataaagcctgtaacgatttcatatcacccatcaataaatacgtctgccagcgccttatggcagagcaggagcgacagcccttcaagatctgcccataccgactgaccataatcctgtttgagcgtaatttctgtacgcgtcagtaactgcacggcctggcgaagctgcgcaggatggagacgctgcaacgcgtcgccgatcatggggcgacggttttgccagacccggtgtttatcaaacagcgcgcgtaacggcgtatgcgcggactgacgtttgagatttaccagtagcagcagctctcgctggagggtgcgcagcagaataaccggttcgctgccttcaaggcgtagctgttgcagaatgtgcagcgcgcgtttgcttttccccatcagtaacgcatccacccagtggaaaggggtaaagtgggcggcgtcattgacggcctgctccacgcgaggaagcgttaacttaccgtcaggccaaagcagcgacagtcgttccagcgcctgcgccagcgccaacagattgccctcatagcaatagcacagcagttggttcgcggcgtcatccagttgcaaattctgtgctttcgctctggcggccacccagcggggaagctgcgcctgctccggcgtctgacaactgacctgaacgctacggtctgccagcgcggtataccaggcggcgttttcctgcgctttggtgagcttgtttccgcgtactattaataacaggtcgtcatgcagcagctcgctcagggtggcgagttgctcattcattgccgcgttaggcccgttttccggcagttgcagcaccagcgtttgacggctggcgaacagactcatcgcctggcagagtgagaaaagcgatccccagtcggtactgggatcgagagtaaaagcgtggtgctcttcgaagccttgcgacgcagccgccagacgaatagcgtcctgactttcctgcagcagcagcggatcgttgcccaatagcagatatgccgcacgcagcccttcattgagctgcgcgcggagttgttcaggatacaacctgatcattagttactcagcgtagtggagacgcgtgctggcgtagaggcgggcgccgccgtctcattgtcggcggtagcctcctctttcgtcgcctgaatatccgccgcgcggacgctggtcagcttacgaatcagctgttcagcggctttgtcgtacatctcctgaacgatcatggcctgctcgttatccttcgccaacgccatctgcgggttatcgaagaacgaacggtacactttcgtgctgataggatagatgtcatggcccggaatcaataccgaggcattgacggtcatcaccatctgatattccgccgtctggccgtcctggaacactgacgccgtatcctgcaaaatagtcaccgttccaagccgcagagacggaacgtctttgcgcgttgtgtctttatcaagcaggtttacgttattcagccgtaactgattacgtaccgcacgacttagcggaccgttcggatcgccggaatcgaggatcatcgttttcattgaagccggaacctgcgtagtgctacgcagatgccagccgcatccggcggtgaccagcaccgccagagataacaacagtgttaccagatatcgcacgcttcctcccgcgcttagccaacaaccagattgaggagtttacccggaacgtaaatcactttacgcacggtaacgccatcaagatattttgccaccagatgttcctggcctgcacgttcacgcacctgttcttcggtagcatccaccggtacggtgattttcccgcgaactttaccgttaacctgcacgacaaccagcgtggtgttttccaccattgcctgctcgtcggctaccggccacggcgcgttgtcgatatcaccttcgccgcccagctcctgccacaaggtaaagcagacgtgcggcgtgaacgggttaagcatacgcacgacggcctgcagcgcttcctgaagcagtgcgcggtcttgttcgccttcctgcggggctttcgccagtttgttcatcaactccatgatcgccgcaatggcggtgttgaacgtctgacggcggccgatatcatcggtcactttggcaatggttttatgcacatcgcgacgcagcgctttttgatcttcgctcagcgcatcgacgttcagcgccgcgacaggacctttagcggtgtgttcgtaaaccagcttccagacgcgtttaataaagcggtttgcgccttctacgccggactcctgccattccagagtcatatccgccggagaagcgaacatcataaacaggcgtaccgtgtccgcgccataacgttcaaccattacctgcgggtcgataccgttatttttcgacttggacattttactcatgccagtgtagaccagctcatgacccgctgcgtcttttgctttgacaatgcggcctttttcatcgcgctcgacgatagcgtcaactggcgaaacccagttacgttcgccgttctcgccgacataatagaacgcatccgccagtaccatgccctggcacagcaactgtttagccggctcgtcagaggtgaccatgcccgcatcgcgcatcagcttatggaagaagcggaagtagagcaggtgcatgatggcatgttcaataccgccgatgtagatgtcgaccggcagccagtagtttgccgctttcgaatccagcattccttcctgatactgcgggcaggtgtaacgcgcgtagtaccatgacgattccataaaggtgtcgaaggtgtcggtttcacgcagcgccggcataccgttaacggtggttttcgcccactcaggatcggctttaatcgggctggtgatgccgtccatgacgacatcttccggcagaataaccggcagttgatcttccggcgtcggcagcacggtgccgtcttccagggtgaccatcgggatcggcgcgccccagtaacgctgacgggaaacgccccagtcacgcagacgatagttcactttacgttcgccgacgcctttttccgccagtttatcggcaatggcgttaaacgccgcttcaaaggccaggccgtcgaactcgccggagttaaacagcacgcctttttcggtcagcgcctgttcggaaagatccggctcggaaccgtcggcggccagaatcaccggcttgatggtcaaaccgtatttggaggcaaattcgtagtcgcgctgatcgtgacccggaacggccatcaccgcgccagtgccgtactccatcaggacaaagtttgccgcccagaccgggatctcttcgccagttaacggatgaatcgctttatagccggtgtcgacgccttttttctccatggtcgccatttcggcttcggccactttggtgttacggcattcgtcgatgaacgccgccagttcggcgttgttcgccgccgctttttgcgccagcggatgaccggcggccaccgccaggtaagtggcgcccataaaggtatctggacgggtggtatagacggtcagggtgttatcgtaacccttcacatcgaaggtgatttccacgccttcagagcggccaatccagttgcgctgcatcgtttttacggtatcaggccagtggtccagcttatccagatcgcgcaacagctcgtctgcgtaagcggtgattttgataaaccactgtgggatctctttacgctcaactttggtgtcgcagcgccagcagcagccgtcgatcacctgttcgttggcgagaacggtctgatcgttcgggcaccagttaacggcagaagtcttcttgtacaccaggccttttttatacagctcggtgaagaacttctgttcccaacggtagtattccggggtgcaggtcgcgatttcacggctccagtcatagccaaaacccagcgtttttagctggtttttcatatacgcgatgttgtcgtacgtccacggcgccggcgcggtgttgttcttcaccgccgcgccttccgccggcaggccgaaggcgtcccagccgattggctgcagcacgtttttgcccagcatacgctggtagcgggcaaccacgtcgccgatggtgtagttacgtacgtggcccatgtgtagtcggccagaaggatagggaagcatcgacaggcagtaatacttctctttgctctcgtcttcggtcacttcaaatgtgcgcttctcatcccagtgaagctgtactttggattctatctcttccgggcggtattgctcttgcatggcagccagtagtcctgttttcgatacagctacaaatgtagctttagaggtggtgtttagatccgcatagcatagcccaaacacgcacgtcaaaacagggggtagaacatttgtcgcgccaggcgtccgtgaggaggtgacgcaaaatgcgacacgactgaggcaaattaccgcagttcctgtcaccgccagatcggcccataaaaataaagtcatataaaccatgtagttaaaaaatggcacgccttttgattagggaagacaggactaaagcaaaggagttaatcgtgaaaaaaaatgcagtggtgattcaccctcaggattgcgtcgcgacggctattacggcgctcaaggctggcgaaaccgccacaatgttcattggcgaacgcgagataagcgttgtgttacatcaggatgtgccatttggccacaaattcgccatctgcgatgtgccttttcatggcgaagtttataaatatggcgaatccattggccgcgccactcaggaaataaaaagtggcgactatgtgcacgtccacaatgtggaaagtgaacgcggacgtggtgactggaaataatataaaacaagggaaaatgattatgagcaatgagacttttttgggtttccgccgccctgacggccgttttggcatccgtaattatgtactgattttacctaccagcgtttgtgcgaataaagtcgcccaggatattgcccggcaggtaaaaggcgcgacatgggtgaataacgattttggctgctgccaggtggcaggagatgcgcgtctgacggaaaagacattgattaatgtggcgaataatcccaacgtcggcgctattgtggttgtgggcttaggctgtgaaggcgcggagccgctgcgcatcgcagaagagattaccgcatttggcaaaccgacctcctgcattaccattcaggaagagggcggcacgcttaaatgtcaggctcgggggatttcgctggcccgcgattatgcgcaacaactctccatgcaaaaaccgcagcaagcaccggttagcgagctgctgctggcgatggagtgcggcgggtcagatacgacatcggggctggcgtctaacccttcctgcggggtcgcctcggataagctgatacgctgcggcggaagctcaattctttctgaaacgacggaatttattggcgccgagcatgtgatggcgaaacgcgcggtgacgccggaggttggtcaacagcttattgatttagtggtcggctgcgaggcgcgagcaaaagcgctgggcgaggatattcgcgggggacagccgacgccgggcaatattaaaggcgggttgactaccattgaagaaaaatcgttaggctgtatgcataaagcgggtcatgcgccgttacagggcgtactggaatatgccgatagcccaacgcatccgggcctgtggattatggataccccggggcaggatattgaatctatttccggcatggtggcggggggagcgcagatcgttatttttactaccggtcgcggaacgcctgccggtaacccaatagcgccggtaataaaaattacgggtaataaagcaacgtgggaaatgatgcaggacaatattgatattgatgtgtccgccattatgtctggcgaggcttctattacgcaaatgggcgaggaaatttatcaggaaattttacgcgtcgcgaatgggaaaacgactaaatcagaagatttaggtcataacgaattctctatttataagatcgcgccgacgttctgataccaaatcgggcagcacaagctgtccggttatctcctgggaataagctatgaaaattaaaaaaacactggaacgttttcctggtggtatgatggttgtaccgctaatcatcggcgcattgtttaaaacttttgcgccggaggcgctggaaataggcggttttgtcacttctatttcgcatggcgcaatggcgattttaggcatgtttttagtctgtatgggcgcggatatccagtttaaagccgcgccgaaagcgctgaaaaaaggcgctgcgatcacctttgcgaaatttgccagcggcgtgattattggcattctggtcggaaaattttgcggcccggatgggttattaggtctgtcggctttagcgattatttcggcgatgaccaactcgaacagtgggttatatgccgcgttggtgggggagtacggcgatgaaaccgacggcggcgcgattgcggtaatatcgttgaacgatggtccctttttcaccatgctggcgttaggatcggcaggcatggtgtcgataccctttatgaatctggtggcggttattattcccattatcattggcatgattttgggtaatctggatgaggacatgcgcaagtttcttaaacagggcagcgtggtaacgattcccttttttgcctttgggttaggatacggtattgatttcgcaagacttatcacggcaggttcttcaggcattttactgggactcatgacggtggcgattggcggattttttaatattttcgccgatcgtctgacgggaggcagcggcgtggcaggcgcggcggtctccaccacctctggcaacgccgtcgcgacgccagcggcaatcgcgctgctcgatccgcattttaccgacctggcgtcgacggcggcggcgcaggtggcggcctcgacgattattaccgctctgtgcgcccccttcctgaccgtatggataaaaaaacgctacgatcgtaaactgaacccagccgccgcaggcggttagcgtttcggcggaaaataaatcacgacgggcggtctcgcccgttcataaaccaacaggatggtgagtgatgaataagacgaaagatatagccgcatctcctctctgttttgtctctccttaccctcaactggcaaaggctgccgaggcgctggtcgcgcagttggattacgccgtcactattcatcaaacgacgcttaatcgtatcctggatgagctacctttattagagtcccgtgggcaccaggtactgattagtcgtggcggatgtgcggaaatattaaaaaagcacagtaaattaccggtagtcgaaattaaaatgtccggctacgacattcttgatgcgcttatcccttttaaaggacaaaaaggcactgtcggtattgtcggcttttccagtgtgatcaaaggatgcgcgcgcgtagcggaacagttaaatattaactataaaatttttaccttacagggaaatgataaagaaacgatttcttgcctgaagcggcaattagcgtccacgccattagattgcattgttggcgataccgtttgtcaggattatttttcaccgctgggctcgcaattccgtttacttgattccagccccgcctcaataaccgaagctctggaagaagcccgctcattatatctggcttttcgcagccaattactcgagcgtcatcatctgcagctgattctcgatcagtttgataaagctgttatcacgcttgatgataccggcgcgttactgcattacaataaatatgcgagccaactttttaaaattaacgcctccggtgagatttatgacgcatctttcctgaaacaggtattgcaccaggagcggcatacattacgtgagggaaaaaccgtcagcgcgaaagtcgtcgatacgccgcaaggcgcgatggtagttaatctgtatccggtatttgcggccagacagttaagccgggtagtgttgacgatgcaaaccgtctccagtttacagggggcggaacatcatgttcgccgccaggaactgtctcgccgcggcttgagcgcccgctatcatttcgacgatctgcttaccgaaaacccggaaatgctgcgtcgtctggcgatcattaaaaattatgccggtacggacgcgactatcttaattaatggcgaaagcgggacgggaaaagaggtgctggcgcaaagtattcataatgccagccaacgcgtcaacggcccgtttgtcgccattaactgcggcgcgatggcccctcagattctggagagcgaactctttggctatgtcgccggcgcatttaccggcgcgtcgccgaaaggcaaaataggcctgtttgaattagcgcaccacggtaccatttttctggatgagattagcgagctggataaaccgctacagacgcgcttattacgggtattgcaggagcggcagattatgcggctgggctcagaccagatgatacctgttgatattcgcgtgattgcggcgaccaatcagacgttaacgaagctcattgcggacgggacatttcgcgaagatctttactatcggcttaacgtattaaaagtgaccaccatcccgctacgcaaacgtccggaggatatcaaagccatcggcctgtcgctgcttactagtttcagccagcattataaacgcccggcactaacgttaaccccggcgctgtggcaagagcttcagcgcttcgcctggcccggaaacgtcaggcagttaagcaatattatcgaacggctggtactctctattgatcactccccggcaacgctggatgagggtcgcctcttgctggacgatctggaagaggggagccgacgcgagccaactacctgccacgactgccagatgctggctggcgattataaaacgattcgcctgcgtattttgagaaaattattagaggcggaaagggataataaatcgttagtggcgaaacggttaaatgtcgatcgtacctcgctgacgcgctggatacgcgagtcggcctgacaagaatttacagactctgtgggcagccttgcaaagcgtaacgcaaataacgtctattattataggcagttaacgatccaagaggtgaagtgatgaacaaggttgctcaatattaccgtgaactggtggcctcattaagcgagcgtttacgcaatggcgagcgcgacattgatgcgctggtggagcaggcgcgccagcgcgtgatgcaaacaggggagttaacgcggaccgaggtggacgaactgacgcgcgctgtcagacgcgatctggaagagttcgccatgagctacgaagagagccaggacgatagcgtcttcttacgggtgattaaagagagtctctggcaggaattggcggacattaccgacaaaacccagctggaatggcgtgaagtcttccaggatttgaatcaccacggcgtgtatcacagtggcgaagtggtgggattggggaatctggtgtgcgagaaatgccactatcatctggcggtttacacgccggatgtgttgccgctctgcccgaagtgtggccacgatcagttccagcgcaggccgtttgagccgtaaggttcattatcgtgagcggacggttgccgtccgccatgttaagcgtgcagttgggcttccagtttgcggatctcttcatcgacgttccatttgcccgtgggctgtgcttttttgaaccagtagagcgcttgttgtaggtcttgtgcggtaccgtgtccatctctgtacatgcatccgaggttgtaccagcccgatgaattgttacattctgctgatttgtggaaccattccagtgctagcgaataattttgctcgacgccatgaccgcatttgtacatccagccgatactgttataggcatcatcgtcaccctggtctgccgcttttcgaaaccagtatattgcctgctggtaatcttgtttgataccttttccgatgtaataacaatagcccatctgatattgcgagtagctgctctcttgtagcgcgctcttcttgtaccaaagggcggcaagggataaatttttccgacatcctttcccattgccatacatatacgccagtctttcctggctggcgcaatggccttgtaatgctgcctgtttaaaccagtagagtgcctgtgtatcattttgctctacgccagttcctgaatgatacattctcccgagattatattgcgcaaggttgtggctctgttctgctcctttgcgataccaggcaacggcctgggcataatctggcgccatcccggtttctccttcctgaacccagcctaatgtgttgaaagcgtggcggtgtccttgctgtgcggctttttctgaccagaataaagccagcgtattatctttcatgtcggtaggcgtgtctttgtatcgtaagccgagccaatattgtgcctcgcagtgtccttgttcagctgcctgctgcaaccaataaaaagagagcttatcctcttcgctgccatctatacgttcgtcattatataaacggcctaatatatattgagcttcactatttcctgactgcgccagttcggttaattgtgctaaagatacgttgtcgcagggatgactggttatggaatgattcattttttaatttatcccgccattgttttttagattaataatatattgcgatttggctttgttgtactctattttagttttcaattgcgtttttatttgtggtgtgaatatattttggcgatttattatggataaagaatcacaatatttactctttgcactttcctcgccgatggaagtattgaacgaggactgtttaccttcacattcgtcaccgaaaatgtatttaggtgtaaaacgtttcgatcttgaatcgtcgtggggtattgaaaatcgcgatgaactgcttcagaccatttcccgcaggacggatgacggtcatgccacacaactggaatggctatatcgccgctggtttaggtatgcgccgcaggagtggcaggagtataccgacgcgctggacgagggagatcgcatttatgcccgattcgtcgctgataccgccgtgtgttgcggcgaaggtggtattcgcagttgggattatgtgcggatgggatttctctgccgcatgggcgtgctcaatgaatggctgacggaagaggagagcctgtggctgcagtcgcggatacagcttcgcgcgctcagctattattccggctggttgccgtacttcagcgcttattacaccgggcgtttgtactggcagttacggaatggcgataacctaccgctgctacgcgagacattcgcccgtaaggagtttgatgacgcggggcgacgtatgatgaataaactgatcgccgggaaggacagtttttacgccacgctgccgtggcgctacctgccccattaccctgaatgcccggacacgcttcaggaggtgagcgatctatgaaaacctgttggcaagtccttggcattgaggccaccacggataccgacgccattcgtcaggcttatctggcgctgctgccgtcatttcatccggaaaccgatccgcagggttttaagcaattgcgagaagcctatgagaatgcattgcaggggacaacatcgcccgccattacggtggttgatgaggatcccgataccccgtgggtgaattatctcagggagatattcggtgatttgctggcggatggcgaacggcgctttcagccgcaggcatggcaggagtttatccaacagatcaataaattatcgatttcacaggtcgaaaaatcgcgctggtggctgtgcgctatcgcgatgaagacctttcctatttcgtactcgtgtctgaaactgctgtcagatcgcctggcctgggaacaggggagtgataatcgagatgtcgatgccgaggaggtggaggatcttttgtttgaaatccgccgtggcgacctgtttgattattcgctattgctgcatttgccagtggcggtacaaaaccagaccattgctttttatgatgccctggacaacacctttttcgagcatcctctctatttcgcccaacttatggcccagcacggcccgtggattatcccggacaatctacgctttcaacgacgtctgttacgctggttcagcaccttgcactggggtattgcggagctgctgcctgtcgcactggcatggcaggaagccgaacccgataacgcaacgccgggttattactacttagcccagcgcgtattttgcggtgaaggcgatagcctgctgccagaactttacgcgcagtggtgggcgcatccttctacccagcttgacgatctgttgctgcgctggtgccgtcagcatcgaccggactttttcccgctgctggtgatggcggttgaggggcgtgagcaggtggatattaacgctgaacagctgctgtatattcccggctcaagcgctcgttcctgcttgctgtgggccgaggcgctgcacagcggcgcattatcgccgctaagcgaaagttttattgcgcggcgtttgaattatggcgcgccagcggtgagtgaggcgcatagccagcatccatactggctgttgtatcaggtggcggatagcctggcgtgcgccgaggagccgtcagcggcattgttacagagtctggtaacgaagcttgatgcgccggatatctgcccgttggaagcgctggttattcgcgggttgctggggcgggctgcggctgtcgccacaccgtgtgaagctgtagtcgcagatgaagaaccggtgacgacggtgacttcgccgagtacggaggaatctggcggcggctttggcctctggcaggtgattaaaatcattttatttattggcgttgtcggccatgtattacgccagtttatgcattagggatatcgaatatggacaaggaagaacaatatttactttttgcgctctccacgccgatggaggtgctatatatcggcaatgagccttcgcatacctctccagcaatgtataccggaattcctgctgtcgatctctccgattcatgggggattgataaccgtgaagatcttattcaaaccatctatcggatgacggacgatggtcatgcggcagatttggctcccttttatatccgctggtttacgctatctcctcgtcaatggcgcgaatttaccgcgcagtttggcgagcagggccagatttatgcgcgatttgttgccgaaaccgcactatgctgcgggcgcggaggcattaaagcctgggactatgtgcgtatggggtttttatgccggatgggggtgttgaatcaatggctgacggaagaggaaagcctgtggctgcaatcgcgtatctatgcgcgggcgtactatttttacgacggttggacgcaatattttgccgcctattcgttgggtcggctgtactggcaggctaaaggggacaccatacaggcatatttcgctcacctaaagtacgacgcttcaggcgcgcggatgtttaatgaactggcctctacgacagagagttattatgcgcagctaccgtggcgtccgctcaacgaacaaccgacatgcccggaaacgcttaaaggagtgagcgatttatgaatatctgttgggaaatcctgggcattgaacctaccaccgatctggaatgtatccgtcaggcttatcttgccctgttgccctcattccaccctgagagcgatccgcagggttttaagcgattgcgccaggcctatgaagaagcgcagcactgggccgcctcgcctgcggaggacgcaaaaatggaagaggtgggcgacgaacatgaaatactggtggcgttcagggaattgctggcatcagagcgcgatcgctttcagccctcggcatggcagaaatttattcagcaattgaaccagtgttcaatggatgagatagataagctgcgctggcagttgtgcgacatcgccatgaaaacggaaacgatctcgctgtcttgcctggcattgttggcgcagcgtctgaactggcagccgcaggaagcagaagatgatgctgatggagaagagctggaagcatttctggagaccgtaaagcggggcgatgcgtttgatctgctaagtctggccaaattgcctcttgttgttcaagaccaaactgacgcctacttttttaagcttgagcatatctggcgcttttatcccgaacattttgccgacgctctacaggttcagggcgcctggataattcccgatgataaacagctgcatcgtaaactattacactggtttagcgccgagcagtggggcatggcggaactggtcgatattgctcgtcgctggcaggccgcggagccggataacgaagatgcgcactattacctgtgcaaacagcgtttgctctgcggtgaaggggaaagcctgttggccgacctttgcgatttctggcagcgttatccctccacgcaggcggacgacctgttgctgggctggtgccgccagcatcggcctgatttcttcccgctggcggtgatggcggtcgaagcgcgctgtatggcggatgccgaatatgtccccggtgaaagcgcgcgcacgcgtttactgtgggccgacattttgcacagcggtaggttatcaccgctggggcgttcatttgttgactccctgttttataagcgaaaagcgatggcgtgggcaaattcacggctgagtacccagggggaacccgaaacgccgctgttggatctgtaccggacggcggagcaggtggtgctggaagcgtttcccaaagaaaagcccttttttcgcctgctgatccggctggaggaggggcaatcctgtccgctggaggcgctgataacgcaggcattgtcatctaaaatcgccatgaagccaggcgatattcgtgacaaaaaggagctggcggaagagctcaggctggcggctgagaaagaagagacaaaattgtcttctgaagcgaaaaccgaagcaccccgtcaggcggaatctggcggggtgatgaaaatcatgaagattgtcggtttgatcgcgttgattgtctgcgcgttaaatcgattcttccattttttctgaacaggggtagtgaaagcgccgttacggcgctttcggctcgtcaatacccagatattcacaggcgcgacggcgtacgtcatcgacacgctgcatatcattagacagcagggccgcgtcgaaatcggtaataatctcccccagcatttcgcgctcatcgcctaacgcgcgtgaccactgctcctctaactgtgctttaaacgtccggttaatcagcatatcgcggggataaattttcagcgccagcagccgctcgcggctggcgtcgatttgctgcgtcgtcagtgaggtggcattgtgactgatgattctggattcactcttgccgtcttccagcagcacgtcaacttccagcagaccattaatatcgtagctaaaacgaatatcaatggcctgaatgtgcccgttcggcttcagcatgacgtcaaaagaatcaatcaggatattatttttcaccttatggctttcgccctggtataccctgacgcaaatagagtcctgctcagggtgcatggtggagtacgtttccacttttgacaccggaacggtggtattgcgttcaatgatgggcgagaaaataccaggcactccctgtcggttgacttccacgcccagcgagtaggggcagatatccgtgaggatcacctcttcaacgtcttcatggcgcaggcgacaggcggcctgagttgcggcgccaagcgccacgatggtgctgggatcgtaactttgatagggcaatttaccgaataagcgcaccgcgatgcgttgcaccagcggcatctgtgacgcgccgccgaccagcaccaggctgtcaatttgctccggtttgagtcgggagtcgcgcagcgcctgctcaatgggcgtgcgcagccggttgagcaacggtagccacagggcttccagctcatcgtcataaaacgtgctttccagaacgctctcctgataaagccagctcatgcgcagcggggagctgctggcgcattttgcggcttcaacacaggcatacagcgcagccagatcgctatccgtcagcgctgatttatcgaggttccagcgtttcagcacttcatcaagcaacaaatgcgtgaaatcttcgccgccgaggtagttatcgccagcggaggcgtgaacttcgataatcggcgtagcgtattccagaacggtcacatcaaaggttccgccccccagatcgaaaaccagcgaacggctattttgctgcgtatgcaggccataagccattgccgccgccgtgggttcattgatcaagcgcacggcgtttaaccccgcaagctcagcggcaaggcgtgtatgcttacgctgctcatcgctgaaataagccggaaccgagatcacgacatccttgattggctgctgaaggtagtcttccgcatcttctttcagcgagcgtaaaaccagcgaagataattccggcgcattaaacgactcttcacccaaatgccagtgagtattactgcccattgcgcgtttaaataaggcagcggttttatctggatgagatgttttacgggctgcggcaggttttcccaccagaatttgtttattttcatccatactaattatggatggtgttaaatattcaccaaatttattaggtattaattgtgcggctccgtcttgccagacggcgattaaactattagtggtgccgagatcgataccaatcgctaacgttgcattatccattgcgtttaatttatcgggaaagagagtttatagaataaagaacaccaccctctggcgtggtgatctttatcaatgtcacgcctggcgaaagtattcatccataatgttcgtcaactccgggcgctcgccgtcatcattgatggcgaaatcgaggaaaaaagcatcggcctgtggcgtgcgtttctgggccagtaaacgaaacgccagcgggtagtggcaagcataaccgggtgcgcgagtcagaaaacggacaaaatcaatcaacaagggagaatgggtataaaacagcgcgcgtaacagtacggcgggaaatccctcttcggtgatcccttgcgccatgattttgttgaggccggcttcgctcaaatcgcctgcggcaataatatctgcgcaggccgcaagatcgggataatgcgttgcgcagttagccaatgcgttcggccagttgacgcgggtataacgttcgtcatggcgagtaaagtaatcctcccaaagggatggcggtagtttttcgtactgtattttcagggggatgcggcgctgaaactgggcttcttccaggcgctcgccgtcataaaatcgcaggcattgctgtcgcgtctcgtagcatgtcatcgccaccggctggctgatgacccaggtcttcacgggccggccttccagcgcggcggcggtggctttatggtgaccatcaagcaggacgcaaagccagctgtcattcatataccaggccagcgcgtggctctctggcttatcgcgataatacccggcgcgttgtgggttaaatcgcgatgggggctggcctggcagtaaaaaacagggttcgccggactggtagtgatagtccacgtcagcaatccactgccctgtggtcgcgggattcggttgtttttcgttacccaccgcccagaaaaaatgtccgttgccatctgtgggataaagttcgcgttcctccagtcggtaatagccatcggcaaagagtgaaaacagcggcgtcagggcggtaaatgcttcgttcaacccgactcctggctgattccactcggcaagtgaggataaaaactccgcggcgccttcatcatcattgctaaaaccggcataaacaaattctgcgcaggtcgggcaccaggcttcagtgtaaaaacgaatcagcggcgagccatgccaggaaagcgtatgaataccggcgtcagagtcgggatcgtggataacgctgggacgaagcaatgcttttccgttacgtactgaaaacgtaatatgggctacatcgtgctgtagcaggctgatttcaggtctattgttacgccaaaacatcgctgttcatccctggattctactttgcgctttatgcgtagtattgcagccgttccgccagcaaatcgacaaatccctggcggtctacatcgaccatcaccgtcgcattcggcttattccccgtcaggaaataataatccaccaccgtcatcccctgggtgtatttcccctgggtttccacgccgacccaacgctcaacggtggtgaaaatctcgggcttgagcagccaggcgatggtgcacgggtcgtgcagcggtgcgccgacaaatccccatttttcgtctttgtggtactccataaagaagtccagcagttcggcgacgatggtggaaatcgggttaccgatggcgcgaaagcgttcgatatcggcggcgtgaatctgtgccttatgagtgacgtccagcccggccatcaccaccggaatgcctgactggaagacaatttctgccgcttccgggtcgacgtaaatattaaattccgcagcgggcgtccagttacccagcgccatcgcgccgcccatgatcacaatgcgggcgattttcgtatgcagttccggatggctattcagcagcagcgccacgttggtctgtgggccagtggagacgatggtgaccggttgtgcgctctcgcgcagcgtttttgccatcagctcaacggcagtgccgctttgcggggcgaatgacggctcgggcagcgccgggccgtcgaggccgctttcgccgtgaacgttatcggcgataatcagttcgcgcatgagaggtttcaccgcgccgcccgccaccggaatatccaggcgtttgagcagtgtcagcatccgcagcacgttgcgcagggtcttctccggcgtctggttaccggcggaagaggtgatcgctttcacttccagttcaggggaggcgagggcgagaacgagggcgatcgcgtcatcatgacccggatcgcaatcaataataatgggcagtgccattgtggctccttgtaagcggtactttgtgacaaggttaacgcccggctggatacgtttcgagaagcgaagaagtaaagcgtgagatagcgcgcactctgacgtgcgcgccgggaagattagtgcaggattttcgcaaggaagtcttttgcgcgatcggaactggggttagcgaagaactcctcttttggcgaatcttcgacgattttaccttcatccataaagatcacccggttagccactttacgggcaaagcccatttcgtgcgtcaccaccatcatggtcatcccttcgttcgccagctcgaccattacgtccagtacctcgttgatcatttccggatcgagcgctgaagttggttcatcgaataacatggcaatggggtccatacatagcgcgcgggcgatcgccacgcgttgttgctgaccgccggaaagctgcgccgggaacttgttggcatgtgcagacaggccaacgcgctccagcagcttcaggcctttatcgcgggcggcggccttatcgcgtttcagcactttcacctgcgccagcgtcaggttttcgatgatcgacaggtggggaaacagctcgaagtgctggaataccatgcccacgcgggaacgcagtttcgccagatcggtttttttgtcgttcacaataatgccgttaacggtaatttcgcctttttgcactggttccagaccgttgacggtcttaattagcgtggatttaccggaacccgatggcccgcagactactaccacctcaccttttttcacttctgttgaacaatcggtcagcacctgaaagtgaccataccattttgaaacatttttcagggtaatcattaaacagtccttttcttcaaatagctgaccagcaacgacgcgctcaggctgataacaaaataaacggcgccggcgaacagaatcatttcgacctgagtaccgtcacgctcgccgatagtcgacgcggtgcggaagaagtccgccaggctgagtacataaactaaagaggtgtcctgaaatagcacgatgccctgcgtaagcaacagcggcaccatcgcccgaaacgcctgcggcagaataatgagcttcatcgactgccagtgggtcatccccagcgccagcgcggcgctggactgcccgcgggaaatactttgaataccggcgcgaataatctcggaatagtaggccgcttcaaacatggagaatgccaccatcgcggagatcaggcggatatcggttttcggcgatagtcccagcacgttttgcagaaagccgggtacaatcagatagaaccacagcaagaccatcaccaacgggatggaacggaaaacgttaacatacgctttagcaaaccaggcgataggggcaaagcttgagaggcgcatgacggccagaatggttccccagactatccccacgataacggcggtgacggtgatcttcagcgtgatgaccaacccggccagtaggtaaggcagtgaggggataatcgaactccagtcaaattcgtacattatttgctccccacgttgcccggcaggcggactttgcgttcaaccaggctcatgaccagcatgataacggcgttaatcagcacataggccagcgtaatggcggtgaaggattcccaggcgtgcgccgagtaatccaacagtttgcctgcctgcgccgccatatccaccaggccgatggttgaggcaatagccgagtttttcaccaggttcatcatctctgacgtcattggcggtacgataacgcgataggcattcggcagcaggacatagcgataagcctgcggcagcgttagccccatcgccagcgccgcgttcttctgcccgcgaggcagagactgaatcgcggcgcgcacctgttcgcaaacgcgggcggcggtaaacagtcccagacagatcattgaggagaggaaaaactgaatattgggatcgagttccgccttaaaccacatgccaagatcttccggcaacagttcaggcaccaccaggtaccaggtgaagaattgcacgatcagcggcacattacggaacagttctacgtacaacgtgcccagtccggagaggaaacggttgggaacggtacgtaaaatgccgaaaatagatcctaccaggaaagcgataatccaggcggtaatcgaaagggcgacggtgacctgaaaaccactccatagccagccgagataggtggtattgccgaagggggcttcctgtaaaaaaataccccagttccagtctattgacatacatctactccgaaaaaaaagggtagcagcgctaccctcgaagattgttgcccggcgatttgcggcttcaggcccgatggggaacgaccatcaggcttatagtctgtccgtgctgagcgacaatcgagaggacaggagtcccgtcccatttagttttagttagttaagcgctttatcattcggtgctttgaacagggctttcatctcgtcagacaactcgaaattcatgttcaggtttttcggtgggatcggatttttaaaccacttatcaaaccacttttccgcttcgccggaggtttgcgcctgggcgatggtatcgtccatcagctttttaaactcagggtcgtttttacgcagcatacagccgtaggcttcctgggactgcggtttaccgacaatctcccagttatccggtttcttggctttggcgcgctcgccggccagcagcgcgtcatccatcataaaggcgacggcgcgaccgctttccagggtgcggaacgagtcaccgtggtctttcgcgctaataatacgcatccccatcttttgctcttcgttaagcttatgcagcagaatttcagaggtcgtcccggaggtgacgacgaccgctttgcctttcagatccgggaaatctttaatatcgccgccttttttagtcagcagtcgcgtcccgacgacgaaaatcgtatcggagaaggcggcctgtttctggcgctcaaggttgttagtcgttgaaccacattcaaaatcgaaggttccgttttgcaatagtggaatacggttttgcgaggtgatcgggatcagcttcacctgcagatcgggcttgttaagtttcttttttaccgcttccacaatggcgttggagtagtcctgggaatagccgaccactttctgctggttgtcgtaataagaaaagggcacagaagattcgcgatgcccgacgacgatcacgccatttttagcgatcttgtccagggtgctaccagcggcaggcgcgccatcttctgcgtgcgcaaggcccgcagacagtcccatgaccagcattgctgtggttagcttacgtaattgcatatccaactcctttatcatctgcgccgtcgacgcattgatagctattgtgatgttgttattgcctgcaacttgcgcgtgcagtgttatgtgtgtttgttaacatttagtgtggcttgttgtaaatattttgctgcgatattgtttatttttgcgaagtgcgccgcaccgttcagaggcaaaaatcctacattgcaccgttcaggtgctaccgatgatcgattttggtgcgaccaggttgcacaagcagccagaacaggtttgccatgtttaacaaagcaatagacgtgccagaatgggggaaaaaggaggattttcaggccggataaatgaagcgctatccggcctggggagagattatttccgtcgttgtcgcagactcatcactaccgcgccaaaagcaaacagcgcggtcagtacccatagcggccagttgccggtacgggcatagggagttaaccccgtggttggcgtgacattggtggtcagtacctggcgtgtgaactgcgggatcatcgcctgaatctcgccctgagggccaatcaccgccgtaataccgttattagtactgcgcagcaacggacgcgccagctccagcgaacgcatccgcgccatctggaaatgttgccacgggccaatggacttaccaaaccaggcgtcgttagaaatcgtcagcagatagtcggtgtccgggcggaagttatcccgcacctgttcgccaagaataatttcatagcagattgccgccgtcagcttatagtcgtgcgcatgtaactgcggctggatataagggccgcggctaaaggaggacatgggcagatcgaagaacggcgccagcggacgcaggatagactccagcggaacgaactcgccaaagggcacaaggtgatttttattgtagcgattgggcgagtcataactgtatggattatccttgcccaacgtaataatcgtattgtaggtgtcgtatcgattctgtttattgagacgcgcatcgacaataccggtgatcagcgtgctatttttttcgcgtaacatctcgtccagcgaacgaaggaagggctgctgattgatttcgagatccggaatcgccgactcaggccagataataatctgtgatttgcctaactctgggcgagtttcgttgagataaatttttagcgtattcagtagctggttttcgtcccacttcagcgactgcgggatatcgccctgcaccagcgatacctgggtcgctttggccggttccagcgtaaaccactggatataacgtagcggaaagggcaaagcaaacagaatcacggcgacagccagcggacgccagttccgcgtcgccagtgccagcgctaacaggccgctgaccatcatcagcaggaagttgatcgcttcgacgcccattaccggcgccaggccttttagcgggccatcgacctgactatagccaaattgcagccaggggaagccggtcagcacccagccgcgtaaaaattcggtgatttgccatattgcaggcgcggcgatagcgacgcgcagccagttggtttttggccacaggcgcgacaaaatcccggcaaacagtccggtatacagcgagagataagctgcaagcagcaccaccagaaaaacgttaaccgggcccggcatgccgccaaactgcgcgatactgacataaacccagttaatcccgctaccgaaaagtccgagtccccagcaatagccgatggcggcagactggagcgggcggcgattaaacgttaaggcctgcagcccgataagcgacactatcgctgcgggccagacgtcatacggagagaaagccagtgttccgcaggcgccgaataataacgccagcagcaggcgaatacgctggcgttcaattaacgaggcaaatgccatttttagtccactattgctgttattcgtccagttttggctggggcgagtcatccgggatcctgacatgcacctgaataatacgacgactatcggccatcgccactttgaactggtaaccatcaatgtcaatggtttcgccgcgggccggtaaatggccgaacgcctgcatcaccagcccgccgatggtatcgacctcttcatcgctgaagtgggtgccgaaagcgtcattgaagtcttcaatcgacgccagcgcgcgaatcgtccaggtatggcggctaagctgacggaagtcgatatcgtcttcttcgtcatactcatcttcaatttcaccgacaatcagttcgaggatgtcttcgatagtcacaaggccggaaacgccgccaaactcatcgataacgatggccatatggtagcgctgggagcggaattccttgagcatacggtcaacccgtttgctttccggtacgacaaccgcggtgcgtaacactttgtccatgctgaaggcttcggcatcgctgcgcataaacggcagcaaatctttggccatcagaatcccttcaatgtgatctttatcttcgctgatcaccggaaaacgcgagtgggcggactcgatgataacatcaagacattcgtccagcgtctggttgcgttttagggtaatcatctgggagcgcgggatcataatatcgcgaacgcgctggtcggcgatgtccattacgccttcgagcatatcgcgcgtatcttcatcgataagctcgttctgcccggaatcacggatcagcgccagcaactcatcacggtttttaggttcaccgtggaaaagctggctgagtagcagggaaaaaaatccctttttactgtttactgtgtcactactgtgtgaattgtcgtcgctcatggcgtcgtatgggttctcatgttagttaatacaaagctcgtcatgcgtatactcagctgtgacggcatgttttgcctgatggcgctacgcttatcaggcctacaaaaggcatgaatgtaggccggataaggcgcaagcgccgccatccggcaagctactattctgcaatcttctcggcaatgtacggatcctcatagcccatagcaagcataatctccgtttcgagagactccatctcttccgcttcgtcatcgtcgatatgatcgtaacccagcaaatgcaggctaccgtgcacgaccatgtgcgcccagtgcgcctccagcggcttgctctgttcttgcgcttcctgctccacgacctgacggcaaataatcagatcgcccagtagcggcatttcaatgccggcgggcgcttcaaacgggaaggagagaacattagtgggtttatctttcccgcggtacgtcaaattaaggtcgtggctttcggcctcatccaccagacggattgtgacttccgcctcttcctgaaactgcggaataacgccgtccagccagcgttgaaactgagcttcatccggcaggcccgcgtggttttcacaggccaactgtaaatcgaggatcacctggctcatttctgttcctgctcctgggcttcacgcttacgctctgccgccaacgccgctttgcgtttttgttcggcctcttcccaggcttcataggcgttaacaatgcgggcaacgaccggatggcgcaccacgtcttcgctgtggaagaagttgaaactgatttcatcgacttccgccagcacttcaatggcatgacgcaagccggatttggtgttgcgtggcaggtcaatctgcgtcacgtcgccggtgatcaccgctttcgagttaaagccgatacgcgtcaggaacatcttcatctgttcgatagtggtgttctggctttcatccagaatgataaaggcgtcgtttaatgtgcgtccgcgcatataggccagcggcgcgacttcaatcacattgcgttcaatcagcttctcgactttttcaaagccgagcatttcgaacagcgcgtcatacagcggacgcaggtacgggtccaccttctgacttaaatcgcctggcagaaagccgagtttttcgcccgcttccaccgccggacgggtcagtagaatacggcgaatctcctggcgctccagggcgtctaccgcagcggcgaccgcaagatacgttttaccggtacccgccgggccgacgccaaaggtaatatcatgatcgagaatattggcgatgtactgcgcctggttcggggtacgcggtttaatcacgccgcgcttggttttgatattaatagctttgccatagtcaggcacgctttccgcgctctgttccagcacccgcgcttctttgatcgccagatgaatttgttccggttcgatatcctgagtctggccgcgcatcggtgcggtatcgacatacagacttcgcaaaatatctgtcgccgcggtcacgcaaatcggacgaccggtcagtttaaagtgattgtcacggcggttgatttcaataccgagacgacgttcgagctgtttaatattgtcatcaaacggcccgcaaaggctcaacagacgggcgttgtctgcgggctcaagggtaatttcgcgagtgtctatattcaaactgttcctcttgtgtctgtatcgccggacgctgaacacttaccggcatctaaggaaattattcacgccatagggaaaaggcgcaagcattgcaatgaagatggggatgaagagagaaaattgcaaggcccgtcgggcgacaggccatgaccaggaagcccgacaggcgtagcgccatcgggcattattgccttttcagcagggttaaggctggtagaatcctacgcccagctcattttctttacgggtacgggcaatgacggactccggcgtttcggcgacgcgcagccccatttcatcttcggtacgcaccacttttccgcgcagggagttcggatagacgtcagtaatttccacatcgacaaacttaccaatcatctccggcgtgccttcaaagttcaccacccgattgttttcggtacggccagacagttccataatgtttttacgcgacgtgccttccaccagaatgcgctgtgtcgtgccgagcatacggcggctccatgccatcgcctgctgattgatacgctcttgcagaatatacagacgctgcttcttctcttcttccggcacgtcatcaaccatatcggcagccggcgttcccggacgcgcagagaagataaagctgtagctcatatcaaagttgacgtcagcgataagcttcatggttttttcgaaatcatcggtagtttcgccagggaatccgacgataaagtcagagcttatctgaatgtccggccgcgccgcgcgcagtttacggatgattgctttatattccagcgcagtgtgggtgcgccccatcagattcaacacgcgatcggaaccgctctgtaccggcagatgcaggaaactgaccagttccggcgtatcgcggtatacctcgataatatcgtcggtgaactcaatcggatggctggtggtaaagcgaatacggtcaatgccgtcgatggcggcaaccagacgcagcagatcggcaaaggtaccggtggtgccgtcgtagttttctccgcgccaggcgttaacgttctggcccagcaggttgacctcacgcacgccctgcgccgctaactgggcgatttcgaacaggatatcgtctgagggacggctgacttcttcaccgcgggtatacggtaccacacagtaagtacaatatttattgcagccttccatgatagaaacgaaagcggtcgggccttctgcgcgcggttccggcaaacggtcgaacttctcgatttccgggaagctgatatcgaccaccgggctgcggtcgccacgcacggagttaatcatctccggtaggcggtgtaaggtttgcgggccaaaaataatgtcgacgtaatgggcgcgttgacgaatgtgctcgccttcctgggaagccacgcagccgccgacgccgataatcagatcgggatttttctcttttaacagtctccagcgacctaattgatggaagactttttcctgagccttctcgcggattgagcaggtattcaacagcagcacatccgcctcttccgccacgtcggtcagttgatagccgtgggtggcgtccagcagatcggccatcttcgatgaatcgtactcgttcatctgacagccccaggttttaatatggagttttttagtcatcgacttgctcttgcgaaatagtggctgaaaagcagggcgcatagtgtaatgctttggcgcggttgtgaccagtatgactgacgtcagccctaatgggtaaaaaatcctgtaaacttgtctaaaacgtaacaggatgaatgaccatgacaaatcaaccaacggaaattgccattgtcggcgggggaatggtcggcggcgcgctggcgctgggtctggcgcagcaagggtttacggtgatggtaatagaacatgccgcgcctgcgccgtttgtggcggacagccagcctgacgtgcggatttcggccattagcgcggcatccgtggcgctgctcaagggactgggcgtttgggaggcggtgcaggggatgcgtagccatccttatcggcgactggagacctgggagtgggaaaacgcccatgtggtgttcgacgccgctgaactcaagctgccgctgttaggctatatggtagagaacaacgtcctgcaacaggcgctatggcaggcgctggaagcgcaccccggcgtgacgctgcgcgttccggcttcactggcggcattgcaacgccgccacgatggttatgcgctggaactggccgacggcgaatgtatcacgccgaagttagtgattggcgccgacggcgcgaattcgcaggttcggcaaatggcgggaattggcattcatgcctggcaatatgcgcagtcgtgtatgcttatcaccgtcaagtgtgaaaatgcgccaggcgacagcacctggcagcagtttacgccaacggggccgcgcgcctttttgccgctgttcgatgattgggcgtcgctggtgtggtatgacgctccggcacgtattcgccagttgcagggtttatcgatgacgcaattgcaggtggaaattaaccagcactttccggcgcgtctgggggcggtgatgcctgtcgcggcgggcgcgtttccgctaacccgtcgtcacgcgttgcagtatgcgcaaccggggctggcgctggtaggcgacgcggcgcataccattcatccgctggccgggcagggcgtcaacctggggtatcgggatgttgatgcgttgattgatgtgctggcgagtgcccgtagctatggcgagtcctgggccagccattcggtgttgaaacgctatcagacgcggcgcatggcagataattttatgatgcaaagtggaatggatctgttttatgccgggttcagcaatgaactgccgccgctgcgtattttacgcaatatggggctgatggcggcgcagcgcgcaggcgtgctaaaacgtcaggcgcttaagtatgcgttggggttgtaacccgttgaatgccttacccggtttgtaaaaacgctcaattgcaggtcgggtaagcgtattgacatcttactttactgcaaataaagcacataaacctaatttccctttaaaatcaatttcataccaaggtgatgccatttcaattgtgcatacgttgtattggcaacgtactactttatgtagcatcagtaatgtggaactcattgattttacaagaatcgccagggtgattaatgcggcgataatccgataccacgtcagtgttgcatgttggacatcaaaccacagaatataaaaagtgatgatgtgaagaatgactttgctggacagggcgcgaatatagaatccacgcagcgccgttttcgaggaaaacgcgacattaatcagcgcgctttgtttttcttgcacagggatccctggcagatacactatccattccgcactattctggcgcaacatgacggcctttttctggtgcagtatatgtagcctcattgacactgccacggggtaaaccagacccaaaataatcaaccaggcggcgctggccgtgatatcaatgaaggtgaaagcgcagagcaagacgaccataaaaaatgttaatggccgcaaaaagagataccaacaaaactggtaattcattgtgaggttaccgaacgatccctgtaaggctttatcatagcgttttactgatagcagggcattaagggggaaacctctttcggaatttataaacgcagaaaagcaaaaagctcgccgaagcgagctttttaaaggtggctggggtacgaggattcgaacctcggaatgccggaatcagaatccggtgccttaccgcttggcgataccccaattgtcgtacttcttgcgctcattagcagagcgtctttaaaactggctggggtacgaggattcgaacctcggaatgccggaatcagaatccggtgccttaccgcttggcgataccccaacaaattattttcgaaccggtcgaatacctcgacgtgttctgaatatggtggctacgacgggattcgaacctgtgaccccatcattatgagtgatgtgctctaaccaactgagctacgtagccagatgatttcttcgatggctggggtacctggattcgaaccagggaatgccggtatcaaaaaccggtgccttaccgcttggcgataccccaataccgtcgcggtgaaccgcaaactcgaagaaatatggctggggtacctggattcgaaccagggaatgccggtatcaaaaaccggtgccttaccgcttggcgataccccatccgtacaacgcttatcggtgaatggtgcgggaggcgagacttgaactcgcacaccttgcggcgccagaacctaaatctggtgcgtctaccaatttcgccactcccgcaaaaaagatggtggctacgacgggattcgaacctgtgaccccatcattatgagtgatgtgctctaaccaactgagctacgtagccatctttttttcgcgttaccttatcggcgttgcggggcgcattatgcgtattgagccttgaagcgtcaacctctttttcatcgaaaaacgtcggaaagtgtctgtttggttaggttgcgaacagcgtggcgcaatattcggcaattattggttattaatcgtttttccgaaagtagtttgctataaaaaaagagcccctaagggctctttcgtcatcgttaatttactggtacgccgactgatgcacgccgaccgcgcggcctgacgggtcatccatcgttttgaatgcttcatcccactcaatggctttggcggaagaacaggccacggacgggccgccgggtacgcattccgccgcgctcggcaccgggaacagctcttcaaaaatttcgcggtacagatacgcctctttagacgacggcgtgttgtatggaaagcggaagcgggcggtttccagttgttgatcggaaatctgtttcgccgccacctctttcagcgtatcaatccagctgtaacctacgccgtcagagaattgctctttctgacgccacgcgacgcttgctggcagataagactcgaagcactcgcgcagcacgtgtttttccatcttgccgttgccgcacattttatcctgtgggttgatacgcatcgccacgtcgaggaattttttatccaggaacggtacgcgcgcttccacgccccaggcggacatcgctttgttggcgcgggcgcagtcatacatatgcagcgcctgtagcttacggaccgtctcttcatgtaactctttggcgttcggcgctttatggaagtacaggtagccgccaaacacctcatcggaaccttcgccggagagcaccattttgatgcccatcgctttgatcttacgcgacatcagatacatcggcgttgaggcgcggatagtggtcacgtcataggtttcaatgtggtagataacatcacgaatggcatcaaggccttcctgcacggtgaagtgaatttcatggtgcacggtgccgaggtggttagccacttcctgggccgccttcaggtcaggcgaaccttccagaccgaccgcaaaagagtgcaactgtggccaccaggcttcggagcgctcctgatcttcgacgcgacgggcggcgaattttttggtgattgccgaaataaccgacgagtccagaccgccggagagcagcacgccataagggacgtcggacatcaggtggcttttcacggattcttccagcgcctggcgcagcgcgtttttgtcggtaacgttgtcttttaccgcatcgaactcaaaccagtcgcgctgatagtactgacgaatttcgccgtctttgctccacaggtagctgcccgccgggaactctttaatggtgcggcagaccggggtcagcgctttcatttctgacgctacgtagaagttgccgaattcgtcataacccatatagagcggaataataccgatatggtcacgaccaatcagataagcgtctttttcgctgtcatacagggcgaaggcgaacatcccctgtaaatcgtcaaggaaatccggccctttttcctgatacagcgcgagaataacttcgcagtcggagcctgtctggaacgcgtaacgatcgccatactccgcgcgtaacgtctgatggttataaatttcaccgttcaccgccagtacgtgggtttttctggcgttatacaggggctgggcgccagcgttaacatcaacaatcgacaagcgttcatgtgcgagaatcgcgttatcgcaagcgtagatgccggaccagtccgggccgcgatggcgcatcaggcgtgacagttcaagggcttttttacgcagttccgctgcatctgttttgatatcgaatacgccgaaaatagaacacatagccttctccgttaatctgttgcgtcgtactttttgtatttgcttgactaaaaaatgccgcaaaggcgtggaaggcgcaaggggattacggtctgaaaaatgaaaaatgcaatcgtcattgttgattagtgaaaaatgattacgtattgcgcggatttattgatggatcttcagttttatcgtggattaattgaattatgtttttcctgatggcgtttcgcttatcagacctacaatgttgttcgaaccgtaggcctgaaagctatgcgtcatcaggcagaggacaggtttagataacgtctatctcggcgacggaagggtaaatccagcttgggcggaacggcatactgtcaatatcattgatcgttgatacgcctgaaagcaccagaatggtctccagaccggcctggaaccccgccagaatgtcggtgcgcaggttatcgccgacaataacggtctcttccgagtgcgcctgcattttgtttaacgccgcgcggatgatccacgggctgggtttgccgacataaaatggcttccggccggaaattttttcaatgcctgcgcacagcgcgccgcaggccggataaaagccgcgaccgtgggtatccgggttggtggcgataaagcgcgcgccattggcgacgaaaaatgctgctttatgcatcatgtcccagttgtaggagcgggtttctccaacgatgacaaaatcagggttcacatcggtaatggtaaaacccgctttatagagctcgtgaataagcgcgccttcgcccacgacatacgcttttttaccttcctgacggcgcagaaaatcggctgtcgccattgctgacgtataaaacacgctgtccggcacgttaacgccagcggtagcaaaacggttcgccagatcctggccggtttgcgatgggtaattggtcagcagcaccagcggcagacctttttccagaatccccgtcagaaattccgccgcaccgggtacggctacgttgtcgtgcatcagcacgccgtcgatatcgcagattacattcttgatggtcatgaactacccagggaatttgtgaataatccgatactataagagcgcatcaactttccagcaaacattgcagcaatgttccgttgagcatggcgcgtttaactaaggcaaatgcgccgatagcagaacggtgatccagcgtggagcgtaccaccggcaaatttttgcgaaatgcctttaacgcctgcgtattgatacagctttcgatagcgggtaacaggactttatcggcttcaatgatctcgccggcaatgacgattttttgcggattaaacaggttgatagcaatggcgatcgttttgcccaaatggcgaccaacatgctcaatgacttccgaggccaggctgtcgccccggtttgccgccttacagatggttttaatcgtgcagtcgtcaagcggaacacggctttgatacccttgtttaagcaaattcagcacccgttgttcaatcgccgcattggcggcaatggtttccagacagccgaaattaccgcagtggcagcgctcgcccagcggctccacctgaatatgcccaatttcaccgacgttgccgttacggccaatgaagatgcgtccgttggagataatcccggcgcctgtaccacgatgaacgcgcaccagaatcgagtcctcgcaatcctgactggcgccgaagtagtgttccgccagcgccaggctacggatatcgtgtcccacgaaacaggtaacgtgaaaccgtttttccagcgcttcgaccagtccccagttttcaacctgaatgtgcggcatgtaacgaatcacgccgctttccggatcgacaagccctggcaggatcaccgagatagcgatcaattcacgaattttacgctgacagctatcaataaagacggcgatagtgttgagcagcgcatgttccagcgtctcctgggtgcgctccggcagcggataatgctcctcagcgaccactttactgctcagatcgtagagcgttaaagtggtgtcatgacgccccaggcgaacgccaatggcgtggaagttacgggtttccgtgacgatagagatagcgcggcggcctccggtagaggcctgctgatcgacttctttgatcagcccgcgttcaatgagttgacgcgtaattttcgttacgctggcgggagcaagctggctttgctcggcaatttgtatgcgcgagataggaccatgctggtcaatcaggcggtaaacggccgcgctgttaagctgttttacgagatcaacgttacctatctgagcttgtccgcctggtgtcatattctcacttactcaagtcaacgacctcgtcaccattaacgatggtcttgataattttaaaatcgtgggtgaacgcggtcaggttggcgactttacccggcgcaatgctaccgagatgtttatcaacgccgatagcgcgagccggatagagcgttgccatgcgcagcacttcatccagcgcgatgccgcaatgcgcgaccaggttgcgtacgccttcaatcatggttaaggacgaaccgctcaacgtaccgttttcatccacacacagtccattgcggtagtatattgttttacctgcgaaaatgaactgctcaatattggcccccgccggtgcggtggcgtctgtcaccagacaaagtttgtcgcctttcaggcgtttggcattgcgaatgttggcgtagtcgacatgcagaccatcggcgataacgccgcaataaatatccgcttcgtccagaacagcgccagcaaggcccggctcacgccctgtaatgtacggcatcgcgttaaacaggtgagtcgcaaaggtaatcccggcgcggaagcccgctttcgcctcttttaacgtcgcgttggagtgacctgcggaaaccacaatgcccgcattcgccagtttagcgattacgtcagcaggcaccatttccggcgcgagtgtgactttggtgatgacgtcggcattatcgcataagaaatcgaccagcgcagcgtctggtttacgcacgaaatcaggattatgggtgcctttttttaccagattaagccaggggccttccaggtggagacccagcgcctggtgcggatgtttttccaggtattcgcgcatgacgcgaatgccctgtttcatcaattcgtcgctggtagtgataagcgttggcagaaagttagtacagcccgatttttcattggctttctgcataatttccagcgtttcaacgctgacggcttctgcggtatcgttaaactgcacgccgccgcagccgtttagctgcacatcaataaaaccgggggagagaatggccccattcaatgagcgttgttctattcccggcggcagttcggccatcggacaaacgcggtcaatcaggccattagcgacaacaagcgcatggtcatcaagaatttcgtgaccggtaaagatccggccctgggttaaagcatacattccgacccccgatatcaaaaatttaccgccccgcattgactggcggggcggagacaacattacagacctttaatattttctgcttctaattcattgaaatatttcaatgttttaactttaagttccattgtggacggctcatcgcataccacaaccgctttcggatggagttgcaggcagctaatggtccacatgtggttgacgttgccttcaaccgccgcctgcagcgcctgggctttctgatggcccagcaccagaatcatcacttcttccgcatccagcagagtacccacgcctaccgtcagcgcgtatttcggcacctggtttacgtcgccgtcaaagaagcgggagttcgctacgcgagtatcatgggttaacgttttgatacgggtgcgggaagccagggaagacgccggttcgttaaaggcgatgtgaccgtcgttgccgacgccgcccataaacagatggattttaccgtaagaacgaattttttcttcatattgacggcattctgcatcgatatccggtgcgttaccgttgagaagattgatgttttctgctggaatatcaacgtgatcgaaaaagttacgatgcataaagctgtggtagctttccggatgctctttcggcaggccaacatattcgtccatattaaaggtgaccacatgcttaaagctgacctcgcccgctttgtgcatctcaaccagcgctttgtacgccgttagcggcgtgccgccggtaggcagtccaaggacaaacggacgatcggcggtcggtttgaacgcattaatacggttaacgatatggcgagcggcccatttgccaacctgttctgcggtactcagggggatcagtctcattcttcacctcaataatcaatgtcaaaatttggcggatcgtattaagcgtaacctggatatccagggttcgtgttcaatccgtcctgattttttgaatcataaaataagttttctgtgttagccagtggatggtaggggtgattacgatatttagtgattataatcacaaaaaacacccgtttaatttgcgaggcgaattaattttccacacactctgcagaagatgatctcaccgttcgattacagaacatcacgtttttaacgtttgcagcacaataaaaaacggcttcaaagaagccatatcggcgtctcgtagggggaataagatgaatattttaggttttttccagcggctgggtagggcgttgcagctccctatcgccgtgttgccggtggcagcgttgttgctgcgattcggccaaccagatttgctgaatatgccgtttatcgcgcaagcgggcgggtctattttcgataacctggcgctggttttcgctatcggcgtggcctccagttggtctaaagatagcgcgggcgcggcagcgctggcgggagccgtgggttacttcgtcatgaccaaagcgatggtgacgattaacccggaaatcaacatgggcgtgctggcggggattattaccggtctggtcggcggcgcggtttataatcgctggtctggtatcaaactgcctgattttctcagtttcttcggtggaaaacgttttgtaccgatcgcaacgggctttttctgtctggtgctggccgctattttcggttacgtctggccgccggtacagcatggcatccatgcgggcggtgaatggatcgtttccgcaggcgcgctgggttccggtatctttggcttcatcaaccgtctgctgatccccaccggtctgcatcaggtactgaacaccatcgcctggttccagattggcgaattcaccaatgccgcaggcactgtattccacggcgacatcaaccgcttctatgctggcgacggcacggcggggatgtttatgtccggcttcttcccgatcatgatgtttggtctgccgggcgccgctctggcgatgtatttcgccgcgccgaaagaacgtcgtccgatggtgggcggtatgctgctgtctgtcgcgatcaccgcgtttctgaccggcgtaaccgagccgctggaattcctgtttatgttcctggcgccgctgctgtacctcctgcacgccattttgactggtatcagcctgttcgtcgcgacgttgctgggtatccatgcgggcttctctttctcggcaggcgcgatcgactatgttctgatgtataacctgccagcggccagcaataacgtctggatgttgctggtgatgggcgttgtattctttatcatctacttcctgctgttcagcgcggttattcgtatgtttaacctgaaaacgccgggccgcgaagataaagttgatgagatggtaacggaagaagccaacagcaacaccgaagaagggttaacgcaactggcgaccagctatattgctgcggttggcggtacggacaacctgaaagcgatcgatgcgtgtattacccgtctgcgcctgaccgtgaatgactctgctcgcgttaacgatgcggcctgcaaacgcctcggcgcttccggcgtggtgaaactgaacaaacagaccattcaggttattgtcggcgcgaaagcggaatcgattggcgatgaaatgaagaaagtggtggcgcggggaccggtcgcggcagcgtctgctgatgcggctcacgttgcaacacctgctccggcggccaaaccccaggcggtgccgaatgcggtaactatcgctgaactggtctctccgattaccggtgaggtagtggcgctggatcaggtaccggatgaagctttcgccagcaaagcggtcggcgacggcgtggcggtgaaacccaccgataaaaccgtggtttctccggcggcgggtactatcgtgaaaatcttcaacactaaccacgcgttctgtctggaaaccgaaaaaggcgcggagatcgttgtccatatgggtatcgataccgtcgcgctgaacggtcagggctttaagcgtctggtagaagagggtgcggaagtcacggcgggtcagccggtgctggaactggatctggacttcctgaatgccaatgcgcgttccatgataagcccggttgtttgcagcaacagcgatgacttcagcgctctggtcatcaaagcggatggtcacgtggtagcgggtaaaacgccactgtacgagatcaagagcaaataatcgcttcctggccggataaggcgtaagacgccatccggcgatatcacaggaaacataagcggcagagggaaaccttcgccgcttttttttaccgcaattagccccaatattttctgcaaagccactttttaagtaactaaaggttgtcagtctgtccggcttataagatcatatgccgttatacgttgtttacgctttgaggaatccacgatgagtgaggctgaagcccgcccgactaactttattcgtcagattattgatgaagatctggcgagtggtaaacataccactgtccatacccgttttccgccggagccgaatggctatctgcatatcggccacgcgaaatctatctgcctgaactttggcatcgcgcaagattatcagggccagtgcaacctgcgtttcgatgacaccaacccggtaaaagaagatatcgagtacgttgattcgatcaaaaacgacgtcgagtggttaggctttcactggtctggcgatattcgctactcctccgattactttgaccaactgcacgcctatgcggtcgagctaatcaataaaggcctggcctatgttgatgagctgacgccggagcagatccgtgaataccgcggtacgctgaccgcgccgggtaaaaacagcccgttccgcgatcgcagcgtcgaagagaacctcgcgctatttgaaaaaatgcgtaccggcggttttgaagagggtaaagcctgtctgcgcgctaaaatcgacatggcgtcgccgtttatcgtgatgcgcgatccggtgctgtatcgcattaaattcgccgagcatcatcagactggcaacaagtggtgcatctatccgatgtacgactttactcactgcatcagcgatgcgctggaaggcattactcattctctgtgtacgctggagttccaggataaccgtcgtctgtacgactgggtgctggacaacatcaccattccggttcacccgcgccagtacgaattctcgcgcctgaatctggaatacaccgtgatgtccaagcgtaagctgaacctgctggtgaccgacaaacacgtcgaaggttgggacgatccgcgtatgccgactatttccggtctgcgccgtcgcggctataccgcggcttctattcgtgagttctgcaaacgcatcggcgtcaccaagcaggacaacactattgagatggcgtcgctggaatcctgcattcgcgaagatctgaacgaaaacgcgccgcgcgcgatggcggtaatcgatccggtaaaactggttatcgaaaattacccgcagggtgagagcgaaatggttaccatgcctaaccatccgaataaaccggagatgggcagccgtgaagtgccgtttagcggtgagatctggatcgatcgcgcagatttccgcgaagaagcgaacaaacagtacaaacgtctggtgatgggcaaagaagtgcgtctgcgtaatgcctacgtcattaaagcggagcgcgtagagaaggatgccgaagggaatatcaccaccatcttctgtacctatgatgctgatacgctgagtaaagatccggctgacgggcgtaaagtgaaaggcgtaatccactgggttagcgcagcacatgcgctgccgattgaaattcgtctctacgaccgtctgttcagcgtgccgaatccgggcgccgcggaggacttcctgtctgttatcaaccccgaatcattagtgattaagcaggggtatggcgagccgtcgctgaaagcggcggtagcaggaaaagctttccagtttgaacgtgaaggctacttctgcctcgacagccgctatgcaacggccgataagctggtctttaaccgcaccgtgggcctgcgtgatacctgggcgaaagcgggcgagtaagcactgcgccaacaggcgaatgctgtaaaaataccttgtcaacgccgcgttctgcggcgttttttctctgcatttctaagtcgattctcttttttgcgaggcgaattaattattctctgaaaattattgatctgataaatgattattaatctaaatgttataagcgtcaggtcaacaggagacaattattttcatgcctatggaaaacaagtcaattttctttctggcggtctgcttcccccaccagcagtcgaatgtaacagaaagcaattaaatatgtgcggttgctcatattattacatactggttacagaaagagattgataattcgcatcgcgaaaaatagtctatttaacgtagtaaatgaggtttctcagcgctactttttattttttcgctgttcgcttttgtcggcagcaatttatacgtcaaagaggattaacttatgcgtacgtttagtggcaaacgtagtacgctggctctggctatcgccggtatcacagcaatgtcggggtggatcgttgttccgcaggcgcaagcctccggctttttcgacgactccacgttaacgggcggcatctattattggcagcgtgaacgcgatcgcaaagatgtgaccgacggcgacaaatataaaactaacctttctcatgcgacctggaacgctaacctggattttcagtctggttacgctgcggatatgttcggtctggatatcgcggcgtttaccgcgattgaaatggcagaaaacggcgacagcggtcatccaaacgaaattgccttctcgaaaaagaataaaggctacgacgaagactattccggcgataagagcggtatcagtctttataaagccgcagcgaaatttaaatatggcccggtctgggcgcgcgccggttatattcagcctaccggtcagacgctgttagcgccgcactggagttttatgccgggtacctatcagggtgcggaagccggcgccagttttgactatggcgatgcgggcgcgttaagtttttcctacatgtggactaacgaatataaagcgccgtggcataccgaaatggataagttttatcaggcggataaaaaaaccaatgtggattatctccactccatcggcgcgaagtacgacttcaaaaatgatctggtgctggaagcggcgtttggtcagtccgaaggctatgtcgatcaatatttcgcgaaggccagctataaatttgatttaggcggcaatccgttcaccaccagttaccagttctacggcgcgcgcgacaaagtagacgatcgcagcgtgaatgatatttacgacggtacggcctggctgcaggcgttgaccttcggctacaaagtcgcggaagtggttgacctgcgtctggaaggcacctgggtgaaagcggacggtcagcagggctattttctgcaacgtatgacgccaacctacgcctcttcaaacggtcgtctggatatctggtgggataaccgctccgactttaacgctaacggtgaaaaggcggttttcttcggcgcgatgtatgacctgaaaaactggaatctgccgggctgggctgtgggtgcgtcttacgtttacgcctgggatgctaaaccggcaacctggcaaagtaacccggatgcttactacgacaaaaaccgcactatcgaagagtcctcatacagtctggatgcggtttataccctgcaggaggggcgtgccaaaggcaccatgttcaaactgcactttaccgaatatgacaaccactccaatattccaagctggggcggtggttacggcaacatcttccaggatgaacgtgacgtgaaatttatcgttattgcgccattcactattttctgatgtcagatgcggcaggctgccggcctgccgcgctgttgaggaacgacctatgaaaaaaattttactcatcgccagcatgaccgccggtttgacggcctgcgcgtcatcacccgcgccggaagaagatagccggctgaaagaggcgtacagcgcctgtatcaataccgcacagggctcgcctgagaagatagaggcctgccaaagcgtgctgaatgtccttaaaaaagagcgcagacatcagcaatttgctaacgaagaaagcgtgcgggtactggactatcagcagtgcattcaggcgacgcgcacgggtaacgatcaggcggtcaaggctgactgcgataaggtctggcaggaaattcgcagtcataataacgtgcaataaaaccctgccttgccacccacgggcgaatgttttccgcccgtggttttttcaggctttattttctgccgcgatatagccgcgactcagacgtacaaacagcatcgccgtcgcggcaagtccacataacgctgcgcacatcagccaccagccgggcgagcttttatcgccggttaactttaccagcgcggtagagatggccggcgtcaggccgccaaaaatcgccgtcgccaggctaaaggccagcgagaaaccaacggtacgcacatagactggcatcacttcggttaacgccgcgaccattgcgccgttatacatgccaaaaaagaaagagaaccacagcagtaccagcgtcatgcgggtaaagtcgggcgcggcggtcagccactgcatgacgggccaggtggtgatcagcgccagcaacgtaatgcccattaacacagcgcgacggccaatccggtcggaaatcgcgccgccaatgggtaaccagataaaattggacacccccactaacatggtgacgatcaaactgtcccgcgcgctgagattaagcacggttctgccataggtcggcgtataaacggtgataaaataaaacgttgtggtggtcatcgccaccagcagcgttccggctgtaataatgcgccagtttttggcgatagttgcaaaaatttccctggtgtcggggcgatgcttgcgttgtaaaaacgcttctgtttcttgtaatgaacgacgtaaaacaaaaatcagcggaatgatcatacagccgataaagaacggaattcgccagccccactccgatatcgcgtcgtgtcccagcgtgatattcaggctataaccaatcaacgcggcaacaacgatcgcgacctgctgactggcggattgccagctggtataaaaccctttattgcctggcgttgcgatttcggacagatagaccgagacgccgcctaactcaacgcccgcagaaaatccttgtaataaccggcccaacagcaccaacgcaggcgctgccaggccgatcgtttggtagccggggacgagggcgatgagcaacgtaccgcagcccataatcgccagtgtcaccatcagccctttacggcgtccgattctgtcaatataggcgccaagcacaatcgcgccgacggggcgcattaaaaaaccggagccaaagacggcaaaggtcaacattaatgaggcaaattcgctttccgccggaaaaaacgttctggcgatataggtggcgtaaaatccgaacaagaaaaaatcaaactgttcaaggaaattgccgcttgtcacgcgcagtattgcgccgaacgtgccggcgcgcgatgttgcaggtgtgtgttgtgccatagggtttgctctccactgtctttattgttttatgggtaagatgttgcgggtcagttgcctgtatcccccgcatgttttccgcgtcgcttctcaactgcccatttgagtaaggccgcgcagcggaaaaatccgtgggcgaattttccgtagggaagggtgagaaagagcgccatcaccacgcctaaatggagcgccagcagtatgcccattccgctggtgtctctgcctgccagcagcgccagcccggtcagactggttaagaacagcagcagaataaagccgcgatccatgggtttctggcgcgcatcgccatgtaacggcgaccgccgcagattgagccacagtagcccggccgggccgataagcagaccgataccgcccagcgtgccgagcatgaccggcaggctaaaaaacgggtagggcgcttcccaaccggcgacgtagtgatagcccgtcgccacgaccgtggcggcaaaacagagcataaaaccgtaaaaggtaaagtgatgaaagcgacggcgcagcagcgtgaacgcatcgtccgcttcgttacagcctttgccgtgaccgccgtcgagatatttcagcgttaacgcattgtgcgacgcttccgcaatctctgccgaacgcggtacgcccggcgagatctcacgccagaagcggattacgcccgccataagcaaaccgattgccagcacaaaaactgagccgaacatccatgccagcaggctatgcggaaaaatttgatagaagtcaccggccagcggcggatgaatcagcgaccctttcagcgccatcgccagtaataaaaagagcgtcagaccgactatcagcgccagcgcgacggtgatccccgcccgacggtataacgcgccaaaagcggcgggctgggcatactgttgatacgtctccaggcgggcttgcgccatcgctttcggcacgttaatggcaaattcatggggcggcgcgtactggcacgcgtgcaggcaggcgccgcagttatgacataaattcgccagataatgaatatcggctttaccgaattcgagccgctgggtcatcgccggaaataccgcgcaaaaaccttcgcagtagcgacacgcgttacacacttgcatgacgcgttcgacctcggcttccggttcggtaagcacggtggcctcaatgattaatttttcaagctgtttcatgctgcgcctccttgtgcgccgcgcgggcggcttctattcccgcaatgcggccaaaggttgtgccgatagacatgcctacgcctgcggtataccccttgcccagaacatttcctgccatcatctcgccggcaacaaacaggttgcggcttggatgaccggcaaaatgcaccgcggcacgttcattgactttcagacccaggtaggtaaacgtgatgccgggtcgcagcgcataaccgtagtagggcggcgcatcaagcgggcgcgcccagtgggttttcgccggcgtcaggtttttagtggcgcagtcatcaagcaaggtatgatcaaaatgaccgggctggcaggcctggttatactgcgtgacggtatgggtaaatttttccgcgtccagccccaactggcaggccagctcagccagcgtattggcctgcgcgccaggaaaaaccggcggcataaagtggccgatggctttgctgtcaataatcgaatagccaatttgtcctggctgttgagcaaccagccgcccccaaatggcgtaacgcttcggccagaaatcttcgccttcatcataaaaacgttcggcgtcgcgattcacgacaatacccagcgatacgcaatccacgcgagtacaaataccgccgtcgtacagcggcgccctggcatcaatcgctacgcagtgcgactgggacggatcgccaatgatatccgcgccggcatccatcataaatttgagtaatacgccctggttaaaacgcgtgccgcgaatcaggaaattatccgcgggccattcgccgcgggcgttttctccccaggcctcccgcagccattcacggtttgattcgaaaccgccagccgctaatacgcaggctttggcggtaatccgttcgctacccgccagcgccgccacgaattcgccgtcatgaagttcaagcgcgtgaaccggcgtgttatagcgaacctgtacgcccagccgttcggcgctacggtaataggcattgacgagcgctttcccgccgcccataaaaaacgcattggtgcgcgcaacgtggagcgccccagatagtggcggttgaaagttaacgccatgtttgcgcatccagtcgcggcattgcgaagaggtgcgaatgaccagccgcgccagcgcctcgttggtgttgccgtcggtgactcgccacagatcctgccagaattcctcttcaggatagctttctaccagcacatcctgcggcgcatcatgcatacagcgcaggtttcgtgtgtgctgagaatttccgccgcgccattcccgcggggcagcctccagcagcagaaccgatgcgcccgcttcccgtgcggtcagggcggcgcataatgcggcattgcctccgcctatcaccagtacatcaaccatcttatactcccgtaccatttaactatttgttaaatttgtaattgaaatgtatacggataaataagcggtgcgctatcaggtagcgctaaacaggggtttagtaagcgtaaagggttgcgcctggccattcaccggcgtcgactaactgacgcataactttggtaaggactactctggcggcaaggccggcgggcgtcagttcatcatccgacaggctgactaaaaaattggggcggctgagtaccggattatggacgccgatcacgcgtagcgcgtcgttatccagatgagaaatcgccgcgccgggctgcaacgtggcgccaagaccgtcgcgcacggcgcgcatcaacaacgccaggccgtcaatttccgcgacgatttcaacgttaagcgcatgttcctggcagacagcgtccagcctgccgcgcagcccatgtccctggcttggcataatgagcggaatgcctgccagttgttcaggtgtgatcgggttatcaggaagcgccgccagcagggcatgggagccaatcagaaaaagctgttcttcaaggatcggtctggcgctccagcgcaggattttatctttttgaaagacaatggctaaatcaatctggcgggtattgatcattctttccagattaccggacaagctttccaccacatgcagtcggacatcggcatagttttcctgcatggcatggataaacggtatacccagtatggaggcggtactgggggccattcctacgctcacatgaccggaaaggcgcgcttctctggcggcgagaatcgcgtcgtcggcatgacgcagggcgagttgcgcctgtgaataaaaggccagcccggcgttggttggcgttacgccgcgcgaagtgcgctgcagcagacggatggcgagctcgttttccagacgggacatctgttgacttaatgctgaaacgccaatatcaagatcctgtgcggcgctgcccatactgccggtttcaataatacgcacgaaatagcgtaactggcgaagctccattcctgctctcctgagatgcgatagcgttttttacattaaatcaacatcaagcggcaggaaagaggaggatataaaaaagccaaccgggcggttggctcttcgaaagatttacacttatttagtcgcgtcatcgtgcgcgtgctcgtcttcgcggcagtcgccttcagcgcagtggccgtaaagatagaggctgtgattagttaaacgaataccgtgtttcgccgcaatttcacgctggcgcgcttcaatagagtcatcactaaattcaatcacttttccgcaatcaaggcagataagatggtcgtgatgatgctgttgcgtcagttcaaaaacggatttaccgccttcaaaattatggcgggtcacgataccggcatcgtcaaactggttcagcacacggtatacggttgccagaccgatttcttcacccatgtcgatcaggcgtttgtataaatcttccgcactgacgtgatggttatctggttcctgaagaacttccagaatttttaaacgaggaagcgttactttcaggccagccttctttaatgcggtattgttgtcagtcatgcggaatctgtcctgttgctaaacgattcacttcattagagaagtgacagaaattgcactcaagataatgcgtatcattataggactgccatgccgaaatgaaaaccgcaagtctctcgcagatgttaataaaactgtggttttgcctgcaaattctggcgccacctgattacacccggacattgtacagggatgggtgcgaaagttacaaatttgtagcaattattttgattggtcttgtctattgatgcggcgcagatataacgctgcgccgcataagattaggcgttgaggatgtcgtcgaggtgcaattcagccgaaacttgcttaacccatttttcaacacgctcggcggtcagttcaggctgacggtcttcgtcaatcgccagaccgacaaaatgatcgtcgtcagccagacctttagaggcttcaaaatgatagcctgcggttggccagtgacccacaatcgtggcgccgcgcggctcaataatgtcgcgaatcgtgcccagcgcatcacagaagtattccgcgtagtcttcctgatcgccacagccaaacagcgccaccagcttaccgttaaagtcaatctcttcgagagtcgggaagaagtcatcccagtcacattgcgcttcgccataataccaggttgggatgcccagcagcagaatgtcatacccttccaggtcttctttactgctttttgcaatgtcatgcacatcggcaacgtctttaccaagctgtttttgaatcatttttgcgatattttcggtattaccggtgtcgctgccgaaaaagatgccagtgattgccatgagtaaaataacctcttgaaacttattgaaatggtggtggcgaattgcccacggataagggcaatcatagcagaacaggcagatatgcggaaacagcaatcacgcgggactgcacgctctgctacacgaaatatgaaacaaaacttattttcagactaaaccctggccgcgcagcgccataagctgcttcattaatatttcttcaatgagctcgctgcggctaatgttgcgcgcttcggccagctcattcagcgcgtcaaccgcttgtgcgttgagttttaattcgacacgcttgaggccacgaactttgtcgcgttttaactggttgcgcttgttgatgcgtaactgttcatcgcgcgaaagcggattcgttttaggtcgtcccgggcgacgctcgtgcgcgaacagatctaatgtcgtacggtccgtttgttctttggccatgattttggtgacttcgggggaaacaatcagccaggcttatgcccggatggatagcgcgccatcatacatcagcgaggaagcgacgccaacgcccgcgcgcgtaatcgcgcacaggcgatgagtttttaatcagttagcgtttatcgtgcagataacggcggatggcgcgcagaaccgcctctggtttttcggcatgtacccagtggcccgcgccggcgatcacatgcgcgcgcgccaaagggaattgtgccagtagcgtgtcgcggtacgcttcggtcacgtacggcgagttaccgcctggaataaacagcgccggatgttcccagggcggaatggtttcccagccgacgatatgcggatactgctcccataataccggaacattaaaacgccattcgccttcagcccaggattttaacagaaactggatcacgccttcttcgttgaggtgctggcgcataatccctgccgcctgttggcgggatgtcgcgtcggattcgctgacggcgttaatggccgcgaaaatgcgatcgtggcggcgaacgtgataatccacgggggcgatatcaatcgcgaccagacgatcgatgcgatcgggcgccagcgccgtcagcgccattaccgcttttccacccatggaatgaccaataaacgtcgctttttcaatctgctgcgcgtcaagcgtatccagaagatcctgggccattgccggataatccatgaccggatcgcgcggcgataaaccatgattgcgcatatcgacctgaataatgtcgtgatcggtcaccagatcgcgcgccagtacgccgaggttgtccaggctgccaaacaggccatgaacgagaacgatgggggaattattgtgcaggttttgtgcagattgcgctcggatgtttaatttcatggcaaagttctttttttcgctctgtcgggttagggtattatgttgaccattctgccactgggctgcaacctctaaggtttactccgagtttttttgtcagccgggcttaacgctatccgctgttgggatttgttcctataatcccaatgacttgtattcagcaaagacatcgcactggattaagatgaaaacgattgaagttgatgatgaactctatagctatattgccagccacaccaagcatatcggcgagagcgcatccgacattttacggcgtatgttgaagttttccgccacgacacagccaacggcttcagcggtgaaggggacgcctgcggcgcaacccgttgccgaagcgaaaccggttaacccggtaaaagacaaagttcgcgcgatgcgtgagctgttgttgtctgacgaatatgccgagcagaaaaaagcggtcaaccgctttatgctgattctgactacactctattcactggatcaccacgcgtttgcggaggcgacggagtcgttgcatggccgcacgcgcgtctattttgcggcggatgaacaaacgctgctgaaaaatgggaatcaaactaaacctaagcacgttcccggcacgccgtactgggtgatcaccaacaccaacaccggccgtaaatgcagcatgatcgaacacatcatgcagtcaatgcaattcccggcggaattgattgaaaaggtttgcggaacaatttaatccttgcattagaaggaccaggcaatggcaatccacaaccgcgcaggacaacccgcgcaacagagtgatttgattaacgtcgcccaactgacggcgcagtattatgtactgaaaccggaggcagggaatgcagaacatgccgtgaaatttggcacttccggccatcgcggcagcgcaggtcgtcacagtttcaacgaaccgcatattctggcgatcgcccaggcgattgctgaagagcgggcgaaaaatggcattaccggcccctgctatgtggggaaagacacccatgcgctctcggaaccggccttcatttccgtgctggaagtgctggcggcaaacggcgtagacgttatcgtgcaggaaaataatggctttacgccaacgcctgccgtgtcaaatgctatcctggtccataacaaaaaaggcggcccgctggctgatggtattgtcattacgccgtcgcacaacccgccggaagatggcggtattaaatataatccgcccaatggcggcccggcggataccaacgtcactaaagtggtagaagatcgcgccaatgcgctgctggcgggcggcctgcaaggcgttaagcgcatctctctggatgcggcaatggcctcgggccacgttaaagcggtagatctggtacagccgtttgtcgaagggctggcggatatcgttgatatggcggcgattcagaaagccggtctgacgctgggtgtcgatccgctgggcggctccggtattgaatactggaaacgtatcgctgagcattacaaacttaacctgacgttagttaacgatcaggttgatcaaaccttccgctttatgcaccttgataaagacggcgcgatccgtatggattgctcctccgaatgtgcgatggcgggtttgctggcgctgcgtgacaagtttgacctggccttcgccaacgacccggactacgaccgtcatggcatcgtgacgcctgcagggctgatgaacccgaaccattatctggcggtcgccattaactatctgttccagcatcgtccgctatggggcaaagacgtggctgtcggtaaaacgctggtctcttccgcgatgattgaccgcgtggtgaatgatttgggacgcaagctggtagaagtgccggttggcttcaaatggtttgttgacggtttgttcgacggcagctttggtttcggcggggaagagagcgcgggcgcttcgttcctgcgtttcgacggtacgccgtggtctaccgataaagacggtatcatcatgtgcctgctggcggcggaaatcaccgccgttaccgggaaaaacccgcaagagcattacaatgaactggcagcgcgttttggcgccccgagctataaccgtctgcaggcgagcgcgacctccgcgcagaaagcggcattgtctaaactgtctccggaaatggtgagcgccagcacgctggcaggcgacccgatcaccgcgcgtcttaccgcagcgccgggtaatggcgcatcgattggcggcctgaaggtaatgaccgataacggctggttcgccgcgcgtccatccggtacggaagacgcttacaagatctattgcgaaagcttcctgggggaagaacatcgcaagcagattgagaaagaagccgttgaaatcgttagcgaagtattgaaaaacgcctgatgggcgatatggaagaaaaaggagccttacggctccttttttgtattaacggcgctgcgcttatcaggcctgtaaaccgcctccaggccggataaggcgcttgtgatatctgacttattcgctctgagtcgccagatgtcggcggcaggtgagggcgtcgcattcgatacgcaccacgcaaaccgctttcatcatatcttcccgataactgaaggtttttcccggatcggtctgacgcataatgacgtccaggccgtagcgcatctcctcgcgcgtttgcaatatcgatgccagtccggtggcgaaaacgctggtgtaggcgtagctataatcacaggggtcatcggcacgtagtaatgcatggtcgccgtccatttcaatgcatactgccgggttcttacgtaacagacgcatctttttcccggtgcgtgcgccgtgaaaataaaatatccagcgtccgttctgatactcgtagccaaaatttacggggacaacatacgggcagagattgtcgttaaaccctatccgacacacttcgtgtttactgagaatagccagtatttctgctatatcagtgacttcccgctctggattactcatttctattatcttattcaaagagtgaaaatgcccggactaccgttaccgcagcccgggcgcgccatcagccgtgtttatttttcaattcaaaacgcggtgagaccaggccgtataacgtccagccgaggaaggtcacaattgagccgtacagcatggcttcttcaccggaggaatagagcgcgtagaagctatacatggcgccaacgaaggccacgaagttagcgactttcgcttttgatgacggcacattcgccattttctgaatgataaccagcgcggccatcgacagaatatacggaataatgttcgtcaccaccgccaggttaaccaggacgttaaactgactattcagcgacgggctaatggtcatcagcgacaggccagtctgaataatcacaatgatcaacatcccctgaaccggcgcgtcgactttcgttacacgagagaagactttcgggaaatagccttcgtcagcggaggatttaaagacctgagcgatagtgaactgccagcccagcagcgagccgcagcaggacattaccatcagcgccatgatcactttacctaccgcaggcgtgaacatctgtgcaaacgccagaccaaacggcgccgtggagttcgccagatccatgttcggcacaatcccggcaatcacgttagtcgaaacgatatagatgaccgccgcgcccagcgtaccgcccagtaccgcaatggggacgttcttttccggattctcgaccacgtctgcgttggcgcaggcggattccagtccaagaaatgcccataacgtcatggcgatggaagaaccgaccgcgctaaagaacggaacatggtgcgggttccatgacgctacgtacatgctggggctaaaccagaaccagccaatgatgcacaggccgacaaccggaatgatgacgccccaaacggtaacgctactgatctgtccggtaatacgcgcgccgccaaagtttgcgatggtacaaacccacaatacggcgatagtcgccagaccgatctggagcggcgtcagcgcggcgccgaacagttcggtaccatagccgacagcggagatggcgatagccacgttggcgatcagcagcgagacgccgtaggtatagttcgccataaagttgccggatttaccgaaggcatattcggcgtaaccgcccatgccgccggatttacggctaaacataccgcatttcgcaaacgcccaggccagtgccatcgagccgacggcggtgaccagccaggagataatggatatcgtgccgacttcagacagtttggtcggtagcatgatgatcccggagcccatcatgttgaccatagtcagaattgtgagctgcacgacacccattttattggatttaggtttactcataatttttcctccttcagcagggagcgctgtgcgtcacgaggtttaatgacgtagcaccagacctgcttacggccgtcgtgttcttcgatataaacgccctgcagttcaggcgcaaagcccggcagcaggttgatcccttcttccagggcgctgaagtaacgcaggacagaaccgccccagatttcacccggaactacacacagcactcccggcgggtaaggcagagcgccttcagccgcgatacgaccttccgcttccggcaggcgaaccagttcgacctcgccgcgcagataggcatagttggcctcttgcggattcatactgactttcgggaaatgcgatttacggaacatctctttttgcagctgtttcacgttgtgccgcgcatagagatcgtgcatctcctggcaaagctgacgcagggtatagccggcataacgcgcttcatgctgtttgtagatggacggtaatacttccgctaacggcgcatcagcttccagcagtttttcgaaacgagccagcagggcgacaagctgttgtaacttcgccatgtcttctgccggcgtcagcaggaacagaatggagttgaggtcgcatttttccggcacaacgccgttctcgcgcaggaagttggcgaggatcgtggcaggaacgccaaagtcttcatattcgccgctcgctgcattaatgcccggtgtggtgagcagcagtttgcaagggtcgacaaagtactgatgttcggcatagccttcaaacgcatgccagtgttctcccggaacgaagtggaagaagcgcagatcgctggcgatctctgacgtcgggtatgactgccacggcttaccatcaatcagttccggtacgaacggacggatgtgatgacagttttcgaggatcaatttacgggcatcgatgccgttaaccacgcaatccatccacatattgcgaccgctgacgccttcgtgcattttggcgttaacgtccagcgcggcgaacagcggatagaacgggctggtggaggcgtgcatcataaaggcgttgttcatgcgcttatgcggaacgtagcgcgattgccctttgatatggctatcttttttatggatctgcgaggtctgggagaaaccggcttgttgtttgtgaacggactgcgtcaccagaatacccggatcgttttcgttcagttccagcagcagcggcgaacaatcggccatcatcggaataaattgttcatagccgacccaggcggagtcaaacaggatgtagtcgcacagatgaccaattttatcgacgacctgacgggcgttataaatggtaccgtcgtaggtgcctaactggatgacggccagacggaatggacgtgcttcgcgggcacgctgcggcgcgacttcgctaatcagctcgcgcaggtaatcttcttcgaagcagtgagcgtcgatcccgccgataaaaccatacgggttacgcgcggtttccagataaactggcgttgcgcccgcctgcaataatgcgccgtggtggttagatttgtggttgttacggtcaaacagtaccagatcgcccggcgttaacagcgcgttgagtacgactttgttagaggaggaggtcccgttcagcacaaagtaggtcttatcggcgttaaagactttcgccgcatgttgctgcgcaatgcaaggcgcgccttcgtgaatcagcagatcgcccatcgccacgtccgcgttgcataggtcggagcggaagagcgtttcgccaaagtattccacgaactgattaccggcaggatgacggcggaagaattcgccgccctgatgccccgggcagtcaaatgcgctgttgccctggttgacataatccaccagcgcgcggaaaaacggcggacgtaactgcgtttcgtagtggcttgctgcggtttccaactggcgaccatagaaggcagtacgggattcattatattcgaatacaccagagatacgcggcaaatactcaggcggtacgcgcccttcgtcatgtgtcgcgacaaacacgggaataccgtaacccgttgcgtcgatttcatcgagttttccgtgttcaatgtcgtcaatggataacacgatggcagccacgtcgatgaaacgactctcatcaacatttacaatattacggtgtgtagaaaaacaatccgggcaatgacggctaacggcaatttttaattctgacatttttcatctctttatttcaggtaatagcaggccctcaatttctcgcatgagaaactgattcttccggaaaaaatcaaagctatcccgctgataaaaaaatcagtaaattagctttattttagatgtaataaatcccaacccgtccggttgcaggaaattcaggatttaaggagttgagtactacgatatacaggcagaaaccgcgataactaaaattgcgctgagtcggaatttcttctgtcaaaccacatggttagctggctgggcgtaaaggaattaccgtactgtcgcttttaacaattcgagttatttaggcaatagacctgaatgacataagggtcggaaagacctgtatgctgaagtacccgtagcagaaaaactaccgggcattaaagaaatgaaagtcgaaactattgcggtgggcaaacatcataatatgcgttgtccgccttatatggggcataaaacgattattattttccattttgaggtcctttcattgatttattgaaagcatggatattttatccaggaagcgccagcaatctgtgaaccagatcaacaaaaaacgatcatttgaaaaataattagtcggcgattatgcatatcgtgctgtgaaataacggattgtttcttaaatgttagttatatgttttttatatcctctataaaatataatatcgccgcgaaaataattattcgcgacgccgaaaataaatgacataaaaattagaagttatttaaaaataatgaatagctattcacggcataaagcgatagccaattccggtttcggtaataaaatggcgtgggcgggtgggatcttgttccagtttctggcgtaaatgtcccatatagatgcgcaaatagtggctatgctccacggcgttaggcccccagacctggtttaataactgccgttgggttaatactttgccggtattattgagtaataccgccagcaggcggaactcaatcggcgtcagatggatttcttcgtcgccacggtggatcaaccgtgcggcgagatcgaccgtcacgccggaaaagcggacgatcggatcggcgcaagggctggcggcgtgccgtcgcagcgcgacacgcaaacgcgcctgcagctcgccaatgccgaatggcttgctcaggtaatcatcagctccggcgtcaagcgcggcaatcttatcgctttcttcgctgcgggcggaaaggacaatcaccggtattgcgctccattgacgcaggtcgcgaataaaatcgattccgtcgccgtccggcaggccgagatcgagaataatcagatcgggctttcgcgtggcggcttccagtaaaccacgttgtaatgtttcagcttcatacacgcgcaggccgtcgccttccagcgcggcgcgcagaaagcggcggatggcctgttcatcttcaacaatcagaacgtttgtcacatatcctcatgaaaatcatcaagttcaggtggctttccttgcggcagcgtcacacggaaacaggcgccgccctgcggtcgattataggcggtaagcgtgccgccgtgtacctctacgatagcatggcaaatcgccagccccagccccacgccggggacggcggactctttgttgccgcgggcgaacttatcgaaaatcttctgttcttgccccgcaggaatacccggcccgttatcccagacatccagttgtaaacgatcgtccttaaccgcagcatcaatgccgatactggcctgcggcccggcgtacttaacggcgttttccagcaagttgatcaggacgcgctcaaataaggggccatcgacatggataagcgttaactgttgcggcagcgacaatgtaatcggatgcaataaacccggctctaacatctgtaacgcgctaccgacgacctcttccagcgtcagccactcttttttaagattaaacccgccggactgaatacgcgccatatccagcaaattattcaccagccgggtggtgttgagaatatgctggcggatttcactggcctgacgcgcgtggggcgatcctgcgctggctaaatccagcgtcaaaatttccgcctggccgaacaataccgtcagcggcgtgcgtaaatcatgcgacagcgccgccagcagagcgttgcgaatactttcgcgctcgctggcgagacgcgcctgttcttcgctggcggtcagcgtcagtcgttccagcgcgttggcgacaagcagagtaaatgtttccagcaggcgttgctgctccggcaccattaactgacgcaaattacccggttcgacgatagccagaccgtacgttttatcggcgcttttcagcggcaggatttgataaggcacgccagggagggtatcggtgcctgcgccggcaggctggcctttatcaaaactccagcgcgcaattgcgtcgtcccacggcgtcatgccttgctggtgggtgagaggcagcaacttaccgttagcatcaggtaacaaaatttggctgcgcgcctggaacgtcgaggcgataaaccgctcgctggtcgcggcgatatcatgttcgctacgcccgacggccagcgctttagacatttcatataaatggcgggtacgctgttcccgataacgggcgacgcgcgcctgatagcgcaccccggcagtaagattgccaatcaccagaccaaccgtcagcatcacggcaaaggtcagcaaatactgcacgtccgaaacggcgagcgtaccgcgtggcgcgataaaaaagagatcgaaactcgccacgttaatcaccgtcgccaccaccgacggccagcgtccgtaaagcagcgcaatcaccactacgcccagcaaatagagcattaccagattggcggcgtcgaaggtgacaagccactgcatagcgataagcgtggtgatggcgcaaagcgccacggcgaccagacagccctgaatctgcccacgccatttctctttaaaaggtcggttatcaggcgtttgcgccaatgcgcgggctggcggctcttccagcgcgacgatcacctgatcgagatccggcgcgcgcctggcaagacggtcggcgaaagcgtcacgtcgccaccagcgtcgcgacgccgggcggcccatgacgattttccccagattatgctcgcgggcatagcgcacgaccgctttctcttcggcgggatcggacagggtggcggtttccgcgccaagctcctgcgccaggcgcagcgcgcttaaaatagcccgccgttgcttttccggtaagcggtgtaacgttggcgtttcgacatagacggcgtgccagacgctgccaagccgggaggccagacgcgccgcggtacgcaccagtttttcgctgccggtgttatgcccgatacacagcaaaatcgcatcgcgggtatgccatactttttcttcgcccggatgcgcgcgccaggcgcgcatctgatcgtccacgcgatcggctgtccggcgtaacgccagctcgcggagggcgatcagattgcccttgcggaaaaaatgttcaatagcgcgttccgcctggccggcgatatacactttaccttcgttgagccgttggcgcagatcgtcgggcggcagatcgaccagtacgacttcatcagcggcatcaaaaaagggatcggggacggtttcgcgcacctgaattcccgtgacgccgctcaccacatcattcagactttccagatgttgtacgttcacggtggtgaaaacgtcgattcccgcttccagcagctcttcaatatcctgccagcgcttaggatggcgtgagccaggcgcgttactgtgcgccagctcatccattaaaatcagcgccggacgccgggcgagggcggcatccaggtcaaattcgcggatttgccgcccccggtgcgagtgacgttttggcggcagaatggtcagcccgtcaagtagtgcggcggtctctttacggccatgcgtctctaccacgccgatcaccacatccagcccctgcgctcgcagccgctgcgcttgcgccagcatcgcccaggtttttccgacacctgcgcaggcgccgaagaaaattttcaacttcccccggtggggcgggggcgtttgttccaacaagcgatccggatcaggacgcaagggttcgtcgttcatttcgctctgtgtccctgtagcgcatccagcgccagattaagctcaacaatattcaccaccggttgcccaagaaagcgcgccagcggcctgtgcgtatattctgcaaccagttgcgcgacctgttcaacgggaagctggcgagccgccgctacgcgggggatttgccatgccgcggcgccgggcgtcagattattatccagcccgcttgccgaggccgtcgccagctcaaccggaaccgcggaactcgcctgggggttagcggcgcgtagcgcggcgacgcgggcctgtatttgcgcatccagttcgggattgctggcggccaggttgcttccgcccgacgccagtggattataaggcgtatcggcggtggcggagggccggccatgaaaatagcccgcggcggtaaacgattgtccgataagcgctgagccgcgtatcacattgtctttatgaatcagcgagccattagcctgccagggaaaccaccactgccccagcgccgtggtcagaagcggatacacgccgccagtcaataacagcagaaataacattgtcgaaaaagcaggacgtaaaccgatcatcatacacctcacgccagacccagcagggtcagcagcacatcaatcactttgataccaataaacggcaccaccagaccacccagaccatagatccataaattacggcgcagcatggccgatgcggaaagcggcttataactcacgccttttaatgccagcgggatcagaaaaataataatcagggcgttaaagatcaccgcgctcagaatggcggagttcggcgaatgcagccccatcacgttgagcgcgtttagctgcggataggtagcggcaaacgcggcgggaataatggcgaaatatttcgctacatcattcgcgatactgaaggtggtgagcgagccgcgcgtcatcagcatctgcttaccgatatgcaccacttcaatcaacttggtcgggttagagtccagatccaccatattaccggcttctttcgccgcctgggtgccggagttcatcgccaccgcgacgtcagcctgcgccagcgccggggcatcgttagtgccgtcgccggtcatggcgaccagccgtccttccgcctgatattgacggatcagcgccagcttggcttccggcgtggcttcggcaagaaaatcgtccacaccggcttcggcggcaatcgctgccgccgtcaggcggttatcgccagtgatcatcaccgttttaatacccatctttcgcagctgggcgaaacgttctttaataccgcctttaacgatatccttgagggcgataacacccagtacgtgcgcgccctccacgaccaccagcggcgtcgcgcccaggcgcgccacgttctcgacgttttgctcgacatcggcgggaaaatggccgccattgctctcgacatgacgccgaatcgcgtccaccgagcctttacggatcatccggttatcgatattaatcccgctcatgcggctttgtgcggtaaacggaacaaaggtggcatgaagcgactgcacatcgcgttcacgcaggttaaagcgctgtttggcgaggatcacaatgctgcgaccttccggcgtttcgtcggccagcgaagcgagctgcgcggcgtcagccagcgtgcgttcgtccacccctcgggcgggaataaaatcggacgcctggcggttgccgagcgtgatagtgccggttttatccagcagcagcacgtcgacatcgcccgcggcttctacggcgcggccgctggtggcgatgacgttcgcgcccaacattcggctcattccggctacgccaatggcggagagtagcccgccgatggtggtggggatcaggcacaccagcaacgccaccaacacggtgacgctgaccgcgttaccgccccaggcggagaagggccacagggtggcggtcgccaataaaaagacaatggtcagggcgatgagcaaaatcgtcagggcaatctcgttaggcgttttccgccgctgcgcgccttccaccatcgcgatcatccggtcaagaaaggtttcgccaggattgacgctacaggcaatcaccagccagtcggaaagaattcgcgtgccgccggtgacagaggcgaaatcgccgccggactcgcggatcacgggcgcggattcgccggtaatcgcactttcatccaccgaggcgccgccttcgatgacctcgccgtcgcagggaataatatcgcccgctttgaccaggacaatgtcgcctttccgcagttcagcggcgggcacgttatcggcctgcgcatcatggcgaggggcgcgcaggcggcgagcgaacgcggtctttttcacccctttcagactgtttgcctgggctttgctgcggccttccgccagcgcttcggcaaaattggcgaacagtacggtgaaccataaccacaggctgataatccctgtaaacaaggcgcttcccgctatttgtcctgttaccatagcgagcgttaacagagtggttagcacgctgccggcccagaccacaaacatcaccgggttacgccactgggcgcgtgggcttaatttttttacggcatccgttagcgcctgtacgagtaaaacaggttcaaacagcgccagttgcttgcgactcatatcaatgtactccacatcgctcaaggtaaagagaaatgctccgctaccgggccaagcgccagggcaggaataaatgtcagcgcgccgaccagcagtaccgtgccgatgagcagtccaataaatagcgcgccgtgggtcgccagcgttccctgactggccggctgtacttttttactgaccagcgagccggcgatggccatgacaggaataatcacgccgaaacgtccgacgaacatgcagaatgccagcaaacagttccagaaaggcgagttagcgctcagacccgcaaaggcgctaccgttgttgttggcggcagaggagacggcatatagcacttcgctaaaaccgtgcgggccagggttcagcattgcgctgcgtccggcatccgtcatcatcgccagcgccgaacccaacaagaccagcatcggcgtgaccagaatcgccagcgcggtcattttcatttcgcgcacgtcgatttttttccccagatattccggcgtgcgaccgatcatcagccccgcgataaacaccgccagcaggacaaacagcaacatgccatacaggcctgaaccgacgccgccaaagaccacttcgccaatttgcatcagccacatcggcaccataccgcccagagcggtaaacgagtcgtgcatggcatttaccgccccgcaggacgccgcggtcgtgacgacggcaaacaggctgctggccagcacgccaaagcgtgtttctttaccctccatgttgacgctactgtccgcgcctgccgccaacagatgtggatttccctgaacttccgcccacatcactaccgctacgcagaccacaaaaatgaatgacattgcccacagtagcgcgcgtccctgacagcgatcgcccgccgcttcgccaaaggcgaaacagagcgcggctggaatcaaaaatatcgccagcatctgcgccagattagtgagcgcggtggggttttcgaacggatgcgaagagttggcgttaaagaaaccgccgccgttggtgccaagcattttgatcgcctcctgcgaagcaaccggccccatcggcaagagttgtttagcgccttcaagggtggtgatgggctgataagccgacaggttttgcggtacgccttgttggataaaaaacagcgcgataattaacgcgacaggaaataatatccatagcgtaatgcgtaccagatcctgccaggcattacccagcgtgtgcacattctggcgcgtaaaggcgcggataagcgcaaaaaccaccgcaatcccggtcgccgccgacaggaaattttgcaccgtcagcccggccatctggctaaagtagctcagcgtgctttcgccgctgtaggcttgccagttggtattggtgacaaagctgacggcggtattcagcgccagatccccggacagccccggtagccgctgcggatttaagggcagccactcctgccagaacaacaggcaaaacaggatgcccagtcccagcagattgagcgtcagtagcgccagtaaatactgacgccagttcatttcgtggtcggtaatgccaagagtccgccagaggatacgctcaatgccagccacgcccggcaacggaacggcggcgatgagccttgccaggcccgaacccaatggtttcgccagtaccaataaaatcagtaaaaaactggcgatcagtaaaaatccttgcgcggccatcagaacgcctccgcattaatcagggcatagaccagataacctaaaagtaagaaaaccagcacgatgccggttatcacgcctgcactcacagagcacctccagtggcattgttttactcctgagaaaggtaattttttggctgcaaagatttcgcaaaaattggcgggcggagtgtaaaaaaagtataaaaatggcaaagaccattatttaactaatgattagtattaatttaacctttttgtaactaatttacgctttgaatgtaaatctgctggaaaagcgtgaaaataagtggtcggatgagtagtaaaattacaccgaaagcggtactattttaatcaggtaacgaggttcaatttttcggtgctattcaccgattcaatctataccggggcgggtagcgtcggtataaaggggggaaacgtatggaacactataaagactatccagcgcatgtcatttttgtccgtcgtgctttcgcggtgatcgcaggcgtgctggcgctgccggtgatgctcttctggaaagaccgcgcgcgtttttatagttatctgcaccgtgtctggtcgaaaaccagtgataaaccggtatggatggcgcaggctgaaaaagccacctgcgacttttattaatcgcgaccagcctgaaaaaccgtcagccgccacgctggcggtttttttatgcgccagggtctacactgtttaacgctattcgccgtgacgtttcatctttcaggagttgtatgcccacccatttagtctggttcaggcgcgatctgcgtttacaggataaccttgcgctggccgccgcctgccgcgatgcatccgcgcgggtgctggcgctttatatttccacccccgcgcagtggcaggcccatgatatggcgccgcggcaggcggcattcatcagcgcgcagctcaatgcgctacagacggcccttgcagagaaaggcattccgttgctgtttcatgaagtggcggattttaacgccagtattgaaacggtcaaaaacgtttgccgacagcatgacgtcagccatctgttttataactatcagtatgagtttaacgagcgtcagcgtgatgcggcggtggaaaaaacgctgccctctgtcatctgcgaaggctttgacgatagcgtgattctggcgcccggcgcggtgatgaccggcaatcatgaaatgtataaagtttttacgccgtttaaaaatgcctggttgaaacggctaaaagaagatatcccgccgtgcgttccggccccgaagatccgggtgagcggcgcgctttctacacccttaacgccagtctcgcttaactacccgcaacaggcgtttgacgccgcgcttttcccggtggaagaaaacgcggtcatcgcgcagctacgtcagttttgcgcgcagggcgcagacgagtatgcgttacggcgcgatttccctgcggttgacggcaccagtcggctttccgccagcctggcgacgggcggcctgtcgccgcgacagtgcctgcaccgattactggcggagcagccgcaggcgctggacggcgggccgggaagcgtctggttgaatgagctcatctggcgggaattttaccgtcatttaatgacctggtatccggcattatgcaaacaccagccgtttatccgctggacaaaacgcgtcgcgtggcaggaaaacccgcactattttcaggcatggcagaaaggcgaaaccggttatcccattgtcgatgcggcgatgcgccagcttaacgcgacgggctggatgcataaccgtttacgcatgattaccgccagctttctggtaaaagatctgttgattgactggcggttgggggagcgctatttcatgtcgcagcttattgacggcgatcttgccgccaataatggcggctggcagtgggccgcctcaaccggtactgacgccgcgccttattttcgtatttttaatcccacgactcagggagagaggttcgatcgcgacggcgaatttatccgccagtggctaccggcattacgcgatatccctggaaaagcgattcacgagccgtggcggtgggcggaaaaagcgggagtcgtgcttgattatcctcggcctattgtggagcacaaacaggcgagaatcgcaacgctttccgcctatgaggcggcgagaaaaggggcgtgatacaggcccggtagcgcaaactaccgggcattctgctatcaggattcgacggccagcgcgcggcttttgaatttgaaggactgatacagccaaatcagcaggacaacccctacgcaggctaacgcgccccaggtgatctgttcaaaaacatccacataggcgttgatggcgtaattaaccgcgccgctggcgtcgaaggcgctttgcgaggtctggtcagcgatgacgcctgccagatagttagctatcgcgccggacagcagcatataaattccggttaatacgccggtgacgccggggatatcaatgcgcgtaatttgcgacatggcgaccgggtcgataaatagctcggcaaagcccatcaccgccagtcccagcaccattagcggcattgaagagtgtccgtaagcggcggaccagcgtgcgctcagggtcagaatacagaatccggcgctcatcagaccgagacccagcgcgaatttgccccagatacgcacggtgcgattaccgcttacgctctctttaaccagccaggccaggacgaccccacacagcatcacggcaaaggcgttcaccgactggaacatggcggtaggaacggaatagcccagaatatcgcggttcacaaagcggtcgatatacaggctgatagaactgccgccctgctgggcaaacgcccagaacagcatactgaacagggtcagggtgacaatcagccccagttctttgcgctgtttggccgtttgcgcctggcgataaatttttgccagcacgaccaggccgatcgcggtcgccacgattaaggcatagacagaccattctttccagaacagaacggtaatcagcaacggcgccgctaccagcaaaattaacagccagccccagttcggcagcaggtagtttctggcgcacaacacggctttattcacgccggtggtgtgggtgaaatgacgatttccacacaggaagatcactaaccccgcaagcataccaatggcggcgagcgcaaagcccatcgcccaactgtactcctcttgcacatagccgcaggcgataggcgccacgatcgaaccaatattgcccgctgcgtaaagcagcgagaacccgccgtcgcggcgcggatcttccggctggtacagttcgcccagcaggcagctaatattcgatttaaacaggccgtagccgcagacaatgatcgccagcgacagataaaggaatgtcggcgcgatctcactggcgcccagcactaaatgacctatagccattaaaaatgcgcccagcatgactgccattcggttgccaagcaccttatccgccagatagccgccaagaatcggcgttacgtagaccagcgaacaataagcgctgaataactcataggcgtggttatcgtcgtattttagctgattggtgagataaagaatcagtagggcgcgcataccataaaagctgaagtactcccaaatttgcagggcgacaacgtagtaaatagcgcggggttgagatgcttgtttattcatcgtatttccgggatagaggcactgcggcaagaacgcggcattctcagataatgcctttctttgtgggcttattaagcctgccgtatcgccgtgtttccttaaagttaccaacatgatacagaactgattttttctgcaatatgcgttctgattgcataaatatacatgaaaccgatcgtgttttgctaagtaatttgcgccaaacccggaggtgattgtttcttgatgtgtcaaacaaatgtttatcgacgaacggctaacggaaggctatgttaacggagactgaacccgtaacgggaaagtagaacgtgggttaaagggagcgatgatgaaaaacaccgagctggaacaactgattaacgacaagctgaacagtgcggcaataagcgattatgcgccgaatggtttacaggtcgaaggaaaagagacggtacagaaaatcgttaccggcgtgaccgcaagtcaggcgctgctcgatgaggcggtgcgtttgcaggccgatgcggtcattgttcatcatggttacttctggaaaggcgagtctccggttattcgcggcatgaaacgccgtcgcttaaaaacgttactggcaaatgatattaacctttacggttggcatctgccgctggatgcgcaccctgagctgggcaacaatgcgcagttggcggcgctattgggcattaccgtgaaaggagaaattgagccgctggtgccgtggggagagctctcaatgccggtgccagggctggaactggcctcatggattgaagcgcgtctggggcgtaaaccgctatggtgcggcgataccgggccagagaatgtgcagcgtgtcgcctggtgtaccggcggcgggcaaagttttattgatagcgccgcccgcttcggcgtggatgctttcattaccggcgaggtgtctgaacagaccattcattccgcgcgcgaacaggggctgcatttttatgccgccgggcaccatgccactgaacgcggcggtattcgcgccctgagcgaatggttgaacgaaaacacggcgttggatgtgacgtttattgatatccctaacccggcataactgagaggcaataaagtgcagcgagcgcgttgttatctgttaggcgaaacggcggtcgtcctggaacttgaaccgccgattacgctggcgagccagaaacgcatctggcgtctgacgcagcgtctggtcgatatgccgaacgtggtggaagccattcccgggatgaacaatatcaccgtgatcttgcgggaaccgcaaaccctggcgctggatgcgattgagcgtctgcagcgctggtgggaagagagcgaggcgctggaaccggactcgcgttcggttgagatcccggtgatctatggcggcgcaggcgggccggatctggcggcggtggcacggcacagcggtttgagtgaaaagcaggtcgtggagctacatgcctccgttgagtatgtcgtctggtttttaggctttcagcctggctttccctatcttgggaatttaccagaaccgctccatatgcccagacgcgcggagccgcgcctgcaggttccggccggttctgtcggcatcggcggcgcgcagacggggatttatccattatccacgccgggcggctggcagctgatcggcctcacgccgttgaagttattcgatccgatgcgggagaccccggttctgctacgccctggcgatagcgtacgctttgtgccgcaaaaggagggaatatgctgaatattattcgcgcggggatttatacctccgtgcaggatagcgggcgtcacggctttcgtcagtcggggctgagtcactgcggtgcgctggataaacccgcctttcagaccgctaatctcctggtcgggaacgatgcgaatgccccggcgctggaaatcactctcggtcaactggttgtcgaatttgaaaatgagacctggttcgctcttaccggcgcaggctgcgaggcgcagttggatgatcaaccggtctggaccggctggcgattgccggtaaaagcgggtcagcgtcttacgctgcatcgaccgcttcacgggatgcgtagctatctggcggtggcgggcggtattgctgtgccggaggtgatgggatcgtatagtaccgatctgaagtccggcatcggtgggctggaaggacggctgctaaaagatggcgatcggctggcgacgggtaaaccatcgcgacagtttagcgggccgcagggcgtgaagcagttactgtgggggaatcgcatccgtgcgctaccggggccggaataccgtgagttcgatcgcgcctcgcaagaagcgttctggcgttcgccgtggcagctcagtccgcaaagtaatcgcatgggctatcgtttgcagggacaatcgttaacgcggacaacggatcgcgaactgctgtcgcacggtttgctgcccggtgtcgtgcaggtgccttacaacggccaacctattgtgttaatgaatgatgcccagacaactggcggctatccgcgcattgcctgcatcatcgaggcagatatgtaccatctggcgcagatccctctaggacaaccgatccattttgtgcaatgttcgctggaggaggcgctcaacgcgcgccgcgagcgtcagcgctatctggaacagcttacctggcgacttcagcatgaacattgatttaaatgcggatttgggcgaaggttgcgccagcgacagcgaattattaacgctggtctcctccgccaatatcgcctgtggttttcacgccggtgatgcgcaaaccatgctgacctgcgtgcgcgaggcgctgaaaaacggcgtggcgatcggcgcgcatcccagctttccggatcgggataattttgggcggacggcgatggttttgccgccggaaacggtatacgcccagacgctgtaccaaatcggcgcgctgggggcgattgtccaggcgcaaggcggcgtgatgcgccatgtcaaaccgcacggtatgctctataaccaggcggcgaaagatcctcatctggcacaggcgattgcgaaagcggtacacgactatgatccgtcactgatactggttggactggcgggaagtgagctgatccgggccggtgagcgccatcgcctggtgacgcggcaggaggtgtttgccgatcgcggctatcaggccgacggtagcctggtgccgcgcatgcaacctggcgcgctgattcacgacgaagagcaggcgctggcgcaaacgctggatatggtacaagccgggagagtgaaaagcgttactggcgtgtggacgactgtcacggcgcaaacggtgtgcattcatggcgacggcgagtatgcgcttgcattcgctcgcaggttacgcgccgcgttcaatgcgcgtaatatacacgttattgcctgagagcccgacgattgaagctattatattacggctgctaaaaattatcgtgttctgttctcttaatgtcaggaagagggatttattcaatactatataaatccccttataatatattattttaaaaataaccaagtgatgctgtaatagccagtatgatgagcttattgctgttagcagcagagtttttgaaaatcattatgatattgttagctatcgccatctaatcaaacctccggggcgggtaaactacctgactctttattacccctttctgattgatttacctcacgatagcctcatttttagcatttatattcctcatcatgacgacttatcaggagattgaagccagattgattcgctgtttcactatcacgtcatggatagcgtgccagattgccagctatatggattttaagctgtttacgcatagcaacttttttagcgaaaattaaactcatctgatcagtgattttttagtatattactcattttgttatgatggatttgttttgtgaaaagaaaatatcttacgcaagaagagattgaaaaactgctgtcagcgaccgacagaatgcccttcccggaaagaaaccgctgcttaatcctgatggcgtttattcacggcttccgggccagtgagctgctggggctgcgcttgtcggatattgatcttgcaggaagacagctttatatccggcgcctcaaaaatggcttttcaacgtgtcaccccctccttcccgatgagtataacgtactgaaaagctggctcagggccaggaagtatcttgagaaaggggctgacggagactggctgttcctgtcgctacgacggcatccgctcagcaggcaacaatttttttacatacttcgtgaggcagggcggttggccgaattaacgatagcgccacatcctcatatgctgcgacatgcctgcggctacgcccttgctgataaagggattgatacacgactcatacaggactatctggggcacaggaatatccagcacaccgtaagatacaccgcaagtaacgccgggcgttttcatggaatatggcgaaaaaaacgtcgagtataaccgtacgttctgattcaaaaagttaagtccgcttcgcgctttcatcatcctctcagatttaccccttccacacaagagtcatacaatcgtaatctattgcttattaaggagttatccatataacaataaaaaaactaagggaaaatttacctggtccaaccagcactatgctgtatccatttttgtcctgcctgcacaaaatgttaattttaagtgttaaaaaaacgtattaaataatacttaatgctgattaattatcatatcaaagaattaaatcctttattttaccttttgaatcatattgttaaatcacagagaagtctgttcagggaaagctgatttacataatcaacatataaatcaatagattactgtgttttctatttgtcattttgtactccgcacagggcagaattaccctgcggcaggagcatgtactaccagggggactgacggcctgtgcagccgaaaagcagaaccggacagggtgtcagagagcagtgtttagatagggccagacgtcatttttcatacagacatggaatggctcccggtccacgaaagggtgcggacatgttgtttccacaacacgaagctgccgttgctggcgcagtgccgggtcggcaatggccagaggagaacaatctgatgacgcaagaatatgcggaaatgtccaccggaaggggggggaccagtaagtgccggtacagtatgggggcgaaaatatttttgctcctgctggcggtctccaccgtcgcagcgttgttcagcctgtaccaggttctgacgtactgatatgcagacgttaaccagagtactgccgcctctccggctgattatgttttgtcagtcaggcgaaaatcctacgcagtttccggataccggcggcctttgcgtggaggactgcgttcgtctcaggacaccagaagggctgctggatcggttgcgtcggtggcccggcgcgatggtgatatccgccggacggccatcaacccagcttctgctgtggcaacaggtttttctgcgttatccgcggacagtggttttttgcagcagtaacgcgtttttaccggttgacgtcagcgtggaaggttacttccgccatctgaggctgattaaacgcgccatgtcggtaagggttctggccagaatggctgagcttgccatatggtcatcactacagacatcgccttacgaggaggagatgaaaagcgcgttgagcgtgccggagctggtgatggagataaacagccgcacgctggtcaggttactgtcagagcgtctgccaaaacagggacggcgggtgctgggattactgttgtcaggctgtagcccggaaatgacggcccgtatgctgggaaccggcgtgaggcaggtctggctcgcggagcagacgctgaaacaacgctgggatatcccgacaggagtaccgctatctgatgcggtaagaataaggataccggacgtcggtccggacattagccaacagagtgggttggtaaaaactggggccggtaacgcaccggatttatgctgacagcatatttacatcatgccgcgcggtattcagacccataatgttgcgttctgaatgagttatcttcacaaaataaatatggcaatcatcgttgtccggaaataccgcataacatgtgacattaatgaatctgtaatcagtgcgagggtttacgcgctgtggcggtagcgtggaattatctggatgcgttgagtaaatttcactttacccttctgatataaatgaaaatggttctggataaactatctaatattatctgtgtctgcaaacagagtgacaaaaataatgcaacgtaaaaagatactaattgtaggtgcgggcctttcaggcgcagtaatagcacgccagttagccgagcagggacatgtagtcaatattattgatcaacgttcacatatcggtggtaacgcttatgatgcccgagatgagcacacgggtattatggtgcacgtttatggtcctcatatttttcatactgataatgaaactgtatggaattatgtaaataaatacgctgagatgatgccttatatcaataaggttaaggccacagtaaatggtcaggtattttctctacctatcaatcttcataccatcaatcaattttttggtgtcgcctgctcacctgatgacgccaggaaattactgcttcaaaaatgtgatagcaccattctggaaccacaaaattttgagcaacaggccttgcgtttcattggtaaagagttatatgaagccttttttaaaggttataccattaaacaatgggggcttcatccttccgcgttacccgcttctgtattgaaacgtatccctgttcgttttaattatgatgataactatttcaatcataagtttcagggaataccaaaatttggttatacacaaatggtcaagtccattgtcgaacacgaaaatatcgctgttgaactatgtcgctccttcactcaggaaatgcggacaaattatgatcatgtttttttcagtggcgcgctggatgccttttactcctgtcaatatggccgactggaatatcgtacattagactttaaaaaaataatttgccagagtgattatcaaggatgcgcagtaatgaattattgttcaatagatactccttatactcggattactgagcacaaatatttttctccgtgggagagacatgaagcttcaatatgttatcaagaatatagtcgggaatgtgaagctggtgatataccctactatcctgttcgcagggcagataaaatggatttactgaataaatatctgtcgcgggctaaaaaagaaaaaaatattactttcattggtcgtcttggcacttatcgttatctcgatatggacatcacgatagctgaagcattacagacggcggacgtatacttaacgtcgctatatgaacaaaaagaaatgccagcttttacagttaccgtttgatgaagtgtacagcgctaatcgtaacttttaaccgtcttgaaaaattaaaaaaaagtgtgcgagagactgttaaggcgggtttttcctctattgttatcgttaataatggctcaagcgacggtaccagggaatggctttcttcattaagtgaacctggcatcacgatacttaatcttaaagataatcttggtggtgctggcggatttaaagtaggtagtcaatatatatgctcatatagtaatgccgattgggtatttttctatgatgatgatgcttacccggaaattaatattttaaagcatttctcgttattagatacctcaagataccgtatatttgcgtcgcgagttcaggacacctatgggcggtcttgtcggatgaatttgcctttcattagggtcccatctacggtgtttgagactatttattatgcgatgcgcccagagaggttttctccagtaagaactcaggttactgatgttcaaactgtgtcattcgttggtatgattattgatcgaaaggtattgaataaccatcttaacgatatccatgatgaacttttcctttattatgatgattttttctttggttataagctagtattgtccgggcagaaaattcgttactccccagaaattaaatttattcatgatatctctattcatggaaagtgtatctgccccgaatggaaagtatattatctttgtagaaatttgttgctgctgagaaaacttttacccgttcccaggatattcagtgttctttctatagtgttacgcctctctaaatatctcgccatattaccatggcagcgtaagaaatttcgttatctatattttatctggcagggaatacttcatggacttaaaggtattagtgggaaatatcattagcaggacgaagagatgaaaaggttatgttattttgtaaattcagactggtactttgatttacattggacagaacgtgcgatagcggcaagggatgcgggttatgaaattcatatcataagtcattttattggtgaagagattataaaaaaattcaaaacgcttggttttatttgtcacaatgtgtctcttgttgctcagtcatttaatatgtttgttttttttagagcattccttaacgctcggaaaattattaaagagattaatcctgacttattgcattgtattacgctcaaaccttgcctgattggtggggttagcgccaggagaagtaatagtccagttgttatcagctttgtcggacttggtcgaatctttttatataataccgtgccaatgagaatattgcgtgcgttaaccgttttggtttacaaatatattgccggtaataagcgtggtgtttttatttttgaacatgataaagatcgacgaaaaatatcgcgtttagtaggtattgattatcataaaactatcgttatcgaaggtgctggaattaacccggatatttataaattctctatagagaaaaaacatgagataccgatagtcctttttgcaagccgaatgttatggagtaaaggtcttggcgatctcattgaagcaaaaaagatcctcagacaaaaaaatattcattttgttttaaatgttgcaggtatattggccgaggacgataaagatgctatccctttggagctcattcatcactggcataatgaaggactaattaactggctgggacgctcttcgaatgtatatgagcttattcagaaatcgaatatcgttgcattaccatctatttatccggaaggagtaccacggcttttattagaggcatcatctgtaggacgtgcatgtattgcttatgataccggcggatgtgatagcttaattattcataactataatgggttgatcgtgaaaagtaattcagctcaggagttagcggtagaattagagtatttgttaaaaaatccacagattcgcttagagatgggggcgaatggaagaaaacgtgtaaaggaattgttttccagcatattagtcattaataagacattgcaaatttataaagacactattggttgctaacaccataaagtgcttatgaagtaggtcagtgtttagataaatagtatgtaaatattatagaaaataaataagttatattttcatatcgttaaagaataagttcttcaggtaaaggtgacacggaaacaatgaatgatttgaaagaagctctggccaggcaccaactttggatttcgctaggttggaatgatgtcctgggacgataccggcgatcggtgttagggcctttttggataacgatttcgatgggggtcaccatatcagcgatgggacctctttacggttcgctgttcagttctggttccgaaaattttatcatgcatcttactttaggtatgatcttttgggcctttctatcagcaactattaatgagtcatgcggaatatttaatgagtccgcatcaattattaaacaatctgaccttccgctatatttatatatattacgtgttttctatcggcagtttatgattatgttgcataattttatcattatacctttcgtgattttttttaccaatacatcggtaaatcttgatattctcctttttatacctgcaattgtaataacatccatctcattaatttctacaggtatgattctcgccattttttgcacaagatatcgtgatatgggaccggttgttcaaagtgtggtaacgttgtgtttttttataactcccatcatttggacatcggaacaattaccaaagggaagaaaggagtttgttgattataatattttttattactttatggagatgctcaggaaaccattaatgggaactgtaccagatgtaactatatggttttacacaataataacctctattattatgttgatggtctcaaccttagtgttgactaaatatcgctcaagaatcgtatactggttataattaatgaaaatctcttgcaaaaacgttggcgtaatactccctatatttaactccagccaccgttcatttaaaaaaacttttctacaggctgcttcaggtggacgaattggctcatcgaataccgggattattgaagtagaggcattaaaaaaaattgattttacgcttaccgaaggtaaccgtcttgcgcttatcggacacaatggttcgggcaaaacaactcttctgagagtacttgcaggggcctataaaccaacttcagggaagtatgaatgtattggtcgagtcaccagcctcattgatcccatgatgggaatggatggtgagcttaccggcctggaaaatataaaactgaggggactatttctcggtctgtcaaaaaatgaaataaaaaatattacagaagatgtcatcgagttcagcgagttaggtgattttattaaaatccccgttagaacgtattctagtggtatggttctgaggcttggtttttctatttctactgcaattaatcctgaaattttactgatggatgaatggatgagcgtgggtgatagtgattttaaaagaaaagcagagatgagattaaatagctttatctctaaagcgggcattatggtaatggccactcacgatgatgaactggctaaatctgtatgtaataagttcatcaggcttgagcacggtgagatagttagcaaaggcggattttaatattcttattgcagtatttatatcactacgcggtgagaaatttactattttataatagcgttaccccagataatataaatttataggttcgttatgtattttttacttcaaaaagtaattttaccaaacattgatctatgcacggaagagcagctttatttcagaactcagggcgggaagtataactatacctcacgtaacttacttgttccgcgtcataaggttgcatattttgatactttttttaatgcattctcaattaagaaatggaaaaaatatacaaccttaacatcactttttttgcgggttaatataattggtcgcggaactataactgtaaggcataaagagaatggtgtcattagagtattaaagcaaattgattttaaatcgtcatgtaatattagtgatgagattgagattgatatatcaaaaataaattttggatatatctatgtggagtggcaatcagacgaagactctgttttaaatggatttgaattgctgactaaagatcatgttagtaaatcatctatggctttagttataacaacttataatagaaaagaagctgttactaaaacaatcaatagaattaataaaacactcttaacccagagcgaatttaaagatcgttttaaattgattgtcgttaataatggcgaggcgattaatcacccgtcaggaaacggcattatagttatcaataatgaaaacctcggtgggtcaggcgggtttatgagaggtttgatagaggcagggaaaatcaacgatgtcaaacatgtcatatttatggatgacgacggctcatgtgaaattgaatcgatttgtcgaactcatgcttttttactgatggctaaagacaaaaatacagttgttactggctgtatgctttttgaagataacccggcaatcatacatgaatctggtgccatatggcatagagattttttacattacccggataaacattatctggatgctcgggaaatagattctttagatacttttgataatgaaagaaaaataggctacggtggatggtggttttttgcctttaatattaacgctattgaatattactcatttcctttctttgttcgtggtgatgacctgctatttggatatatgcataaaaaacataatattgtcacacttaatggtgtggcttcgtggcaaatggattttgaaagaaaaatatcggttctaaatagctatttgaacttcaggactgttgctgtacctgcattaattagtaaaagaaagtttgctgcactactgttaagtgttttctttgtgcgggaagtctttcttgcgagtttttcatgccgctatgaacttgccagagcaatgattatgtcatataacgattgtctttctggacgggagttttgggaagataatgtagatcttctggagataagaaaaagaattaatgcaataactcataatgaaaaattcaatgtagaaggtattgatattgttaatggttgtgttgattacccatgttctggtaaagaaaaagccatctacaaattttttagatgcataacccttaatggacacttaattccagctttctttttaattaaaaaaccaatcgtggttgattatcgtcattatcaccctactaagttttcattccggagaattactatctatcatttaaatatagaaaatggcaaattattaaaacttacccactcaaaaatggagttttttaaagttattattaatggtttgtttacggcagtcaaaaatttttatcggtttaaatctgcaaaaaaagagatgaaaaatagtttgccctatcttacctcaaagctcttttggtataaaaaattcaataaaaaatctgaagataaatattaaacatgatgtaagtggtgttgatgagaattataccgattttttaattatatgactatgataatcttaggtatggttctgttgctacaccttatctggtgtcagtctaataaaatattataatccttacccaatgtcagcatttattcatagggtgttaatttttatatataccgtaaaacgcgaaatcagaatatggaaaagagtcttttagttattgtccgacataaacctgggcgtactcgtctattaatgcgggccttgcaatccattaatgaccagacgttcaaaaaaataaatatcatcattttctgcatggaggaagaattgaaatgtcacaatgtggatgatttttatctgaaagaactgtcaaatatatatagtgttatctacgacgaaagctgtatctttaatgctattaagatgtctgaatctaattatttatgctttatggatgatgacgattcttgggcccctgaatatgtgtcaaggctactcagtgttttggcgaatatacagtcaacgtattcatctgtaaatgcaatagcatgccatacaaataaagttgctgagattgcggaaaataatagaataattataaattcaacgcaaccatggaaccactatttaaatgctggccctgttagttttgatgttatttattacaggaattctattccactttcctcgtgtttattcgataaaaattctgttatcgatatgattgaaagtcataaattatcctctcctgcatttttctggcctttttttattcattaccttgcagaaaatgatgtttggatcttacctgaagcactggcattttatcatttcagagaaaatgatgactttgaatttggcaattataccgtaattaacaatgagttatttgatatagaatgcaaaattgcagaaaataaaatgatgagaagtattgatgactcatcattgctcaatgtgttactttcaaatattgctaacaatagtctttttcataaaatttcttatattgaaaataagattaaataaaatatggatatgaactttaaaaaatacaagaccgtaagctttgatatctttgatacattggttagccggaggatttaccgtcccagagatttgttttcattaatgcaatcaactttagcaactgagaaattttttatatcagcgtacgagattggtattattgataatttcccagagataagagttcaggcggaagtaagtgccagagagaatagggtcaggcgttttggcggcgagccggaaatacttatatctgaaatatacgatgaaattttaaaaaagcatccgcagctttcaccagcgacagtaaaaaagataatcgatctggaaatacaaatggagaagattgttttatataaaaatgcgcgtggaagctgtttgtttgaaaaggctattagtgatggttgcaaagtcattttaattagtgacatgtaccttccatcagcaatattaaaggagttgttaacatcatgtggctatgatatcagtaacattccagtttattcatctggcgaagagcggtactctaaaaatagtggtaaattattttcaatagtcaagaaaaatgaaaatgtagatattgcatcgtggatgcatgttggcgacaatgttcatgctgatattctgaatgctaaaaaactcggcataaatactctccatgctgattggtcagagtataatcatgggatatctaatcattggaaagctaaagatattattggtgaatctatttgtaagactttattacttaaacaagtttctgctttccatcaaaatgatcctttaaacgagataggatttaaagtatttggtccattattattaggttatgtatcctggttagcgaatcagttaaagattcataaaattgataaagcgctttttttagcacgcgatgctcacttaatctataaaatttataatgaatacttttcagaagaacatgtaaaatgtgaatatttatatatatcccgcgcatcagcttatatggtggggatgactgattggccgatgcacaggatttggcatctttttggtggtaagaataagaaaagtattaaaaagatacttgctatcgcggggttagatgcgagtgagcatatttcagatatacatcatgttggttttcctgacgaggagtatattcctgtttcaggagaggaacataaggttcactggcttataaataaattatttccatatattttattaaaaaatactcagcacagggaagtttacgctgattactttaaaacggcctgtgaaggttataaaaatatagcacttatcgatgtaggatggatgggtaatattcaatcagtatttgctcgttctttaggtgcgcaatgggcagaaaaacaaatacatgggttttatttggcaacttttgctggcgccaatgataaccgatctatttataataagatgtttggttggctaaccaactatggccatcccaacgataagtgtgatcttttcttatcaggaggggtggaaataatggagttcgctatggctgacaatactgggtcaacaattggctataaaaaaacggataatggaataattcctgtacgtgaagatagcagtggttctgaaattgagtatttaaaaaaagcagcaagattgcaatcagggattatttctttttttgagtacgtcaaaccgctcatacaaaaaggaaattatgcagcacttagtagtgttgtattgtcagaacctttttttgaattgatagccagaccctcaagcgctcaactggacgccttatcttccctcacacattcagagtccgcgggatctaacgcagaaagaatcgtgctagccaagaaactgcctttaaaggataaactttttcccggagaaaattatatcaaagagttgaatgccagttattggaaagaaggctttaaaaggatcaacagaaaaaaattttgggcaaaatataactaagcgtcatttaattccggtaggcagacaatcattattgggcgctcgcccgacaagggctgagtcgattatgccctggcgcgatcatgttaaccctgacggggaagtggtctcgtgctgcgataatgttattatcactggataccaccgcctgtttgtccatccgctgtggatgttcattatggtgttcgatgtgcattccagatagtcagaggcggtgtagtccattaatcaactgttaacaaaggatattatcatgcctgaaggcccggaaattcgtcgtgcggcggataatctggaggcggcaatcaaaggcaaacccttaaccgatgtctggtttgcctttgcacagttaaaaccgtatgaatcgcagcttaccggtcaacttgttacccggatagagacgcggggaaaagcgttattgacccacttttcaaatggcctgacgctctacagccacaaccaactctatggcgtatggcgggtgatcgatactggtgaaataccgcagaccacgcgtatattgcgcgtcaggctacaaacggcggataaaactattctgctttatagcgcgtctgatatcgaaatgctgacagcagagcagctcacgacgcacccctttttacagcgagtcggtccggatgtgctggacgcgcgtctcactccggaagaggttaaagctcgattgctgtcgccgcgttttcgcaaccgacaattttccgggctgttgctggatcagtcctttctggcgggactggggaattatctgcgcgttgaaatcctctggcaggtaggattaaccggacagcataaagcgaaagatctcaacgaggcgcaactgaatgcgctttctcacgcgctgttggatattccgcgcctttcctacactactcgcggtcaggcggatgagaacaagcatcatggcgcactgtttcgctttaagcttttccaccgtgacggcgaagcgtgtgagcggtgcggcggcattattgaaaagacaacactgtcctcacgcccgttttactggtgcccgcattgccagaaatagccggaaccgacatcggcgagcggctattgcctgatggcgcgacgcttatcagccctacaaaggttgtttgggcgcataggttgatataaaacgggccactgctggcccagttaacagaatgctgaacagccgtagggtttgcattgccatgatgagcgccatatcggcactgcttcctgccgcgatcgcggcaaccgtatccagaccaccgggactggtggcaagataagccgtcataaaatcaatctgcatgtagtaagccattccccacgccatcgcggcgcaaatcgccatcagcgcgaaaattgacaataagatttgcggcaatggccgcagcgccataaaaaacacctgtctgtcaaaacccagcccaatacgccagcctatcgccatatacgccacggccagcagccattcgggtaattcaatctcaatgatgccttgcgaatggagaagcgcgcctgccaacatggggagcagcatcgtgccggaagggatacgcatcaggcgaccggcaatgcccgccacgatcgctaataacagcgtcgtcaatacattaccgctaagcggcggaaaccagatcacctgttggctgaccgctgccgcgctgtcgccgagtatcaggcgtgtcaccagcaccgccgcgccagccacaaacagtacccgtagatactgcataaacgccaccaggcggatatccgccccgtaatcttgcgccatcgctaccattgccgccgcgccgcccggcgaagacccccatgcgccggtgttgccgggcagtgagctgtaacgtaccagcagccagccgactaccgcgctggaaagcagcgtcaccagcaacactaaaagcacgaccggccagtagagggcgagggtggtcaatatcgaaccggttagattttgggcgatcatacagccgagaattgcctgcgcggcgagaaaaataccgcgcggaagttgtagcgtactacctcgcaaactcaacacgatacccgcaatcattggaccgagcagcattgccgccggaaggtgcagatagagaaaaataagggaaatgagcagcgataacaggaacaacaaaaaccactgcagaatcggcattccatgctccctgaatgatatttagcgaaaccttaattaatcatagagagtaacggggtaagaataaaataatgaggataagaaaaaagggaaaatgtaccggatggcgagggttgcgtcgccatccggttgtcaattaacgcttcagcgccgatttaaaatcgcgtttatcgtagccggtatacagctgacgaggacgggcgattttcatgccgtcagtgtgcatttcattccagtgtgcaatccagccaacggtacgcgccatggcgaagatcacggtgaacatggaggacggaatgcccatcgctttcagaatgatgccggagtagaagtctacgttcgggtacagtttcttctcgatgaagtacgggtcgttgagcgcaatgtgctcaagctccatcgccacttccagcagatcgtctttggtgcccagctctttcagcacttcgtggcaggtttcacgcatcacggtggcgcgcggatcgtagtttttgtaaacacggtgaccgaagcccatcaggcggaaagaatcattcttgtctttcgcacggcgaacaaattccggaatgtgtttaacagagctgatttcttccagcattttcagcgcggcttcgttggcgccgccgtgcgcgggtccccacagggaggcgatcccggcggcaatgcaggcgaatgggttggcgccgcttgaacctgcggtacgtaccgttgacgttgaggcgttctgctcatggtcagcgtgcaggatcagaatacggtccatcgcgcgctctagtaccggattcacttcataggtttcacacggcgtggagaacatcatgttcaggaagttaccggcgtaggaaaggtcgttgcgcggataaacaaacggctgaccgattgaatatttgtaacacatcgccgccatggtcggcattttggacagcaggcggaacgccgcgatttcacggtggcgcggattgttcacatccagcgagtcgtggtagaacgctgccagcgcgccagtgatcccgcacattaccgccatcggatgtgagtcgcgacggaaagcatggaacaggcgagtgatttgctcatggatcatcgtatggcgggtgactgtcgttctgaactcgtcatactcttcctgcgtcggtttttcgccgtacagcaggatgtaacagacttccagatagttggaatcggtagcaagctggtcaatcgggaaaccgcgatgcaacaaaatgccttcgtcgccgtcgatgaaggtgattttagattcgcaggatgcggtagaggtgaaaccagggtcaaaagtaaaaactccttttgaaccgagactacgaatatcaataacatcttgaccgagtgtaccttttagcacatccagttcaatagtagtgtcaccagtaagggtgatttttgcctttgtatcagccatttacggtctccttagcgccttattgcttaagactgccggaactcagacttgccttctccacgtcatcttcctcgtcgttagtgcagggaagattctgtgtatgcatcaatcaaccgttaccagtttgttatttggctcgccgctctgtgaaagaggggatgacctgggtacagagcaatgggcgcttgcaggtaacgacttgattaatttcgaattagcagcaaatcaggaacgtagcaatccgagtaatgtaacctgtctatcactaataactgtcctgaaagaatgggtcaatatcattgtactgttgcataacttattaacaggtgaaagagtgaccccataacttttacgcattatatgctttttctggtgtcgtttgtaacaattttgtttaatgtttgtcaaatcagatgattgaaaattaaaaaaatgttgttatcgtgacctgtgtcactgttcaggataaaacccgacaaactatatgtaggttaattgtaatgattttgtgaacgtcctatactgccgccaggtctccggaataccctgcaatcccgagccacccagcgttgtaacgtgtcgttttagctactggaagcagtgttttacatgacgcgcagttatagaaaggacgctgtctgacccgcacgcagaccggaggaaggaaatcccgtcgtctttctggctacaggtagattcacctctgtaaccgaagtcttaagggaataataagaacagcatgtgggcgttattcatgataagaaatgtgaaaaaacaaagacctgtcaatctggatctacaaacgattcggttccccatcacagcgatagcgtccattctccatcgcgtatccggtgtgattactttcatcgccgtcggcatactactgtggctactgggcaccagcctctcttctccggaaggattccagcaggccgccgacatcatggacggcttcatcgttaaatttatcatgtggggcatccttaccgcgctggcgtatcacgtcatcgtgggaattcgtcacatgttaatggattttggctatctggaagaaacattcgaagcgggtcaacgctctgccaaaatctcttttgttatcactgtcgtgctttcacttctcgcaggagtcctcgtatggtaagcaacgcctccgcattaggacgcaatggcgtacatgacttcatcctggtccgtgctaccgctatcgttctgacgttatacatcatctacatggtgggttttttcgccacgagcggcgaactgacctttgaagcctggaccggtttcttctcatcggccttcaccaaagtcttcaccctgctggcgcttttttccatcttgattcatgcctggatcggcatgtggcaggtgttaaccgactacgttaaaccactggcagtgcgtctgatactgcaactcgttatcgttgttgcgctggtggtttacgtcatctatggatttgttgtggtgtggggtgtgtaatgaaactgccagtcagagaatttgatgctgttgtgattggtgccggtggcgcaggtatgcgcgcggcgctgcaaatttcccagagcggccaaacctgtgcgctgctctcgaaagtcttcccgacccgttcccataccgtttccgcgcagggcggtatcaccgtggcgctcggcaatacccatgaagataactgggaatggcacatgtacgacaccgttaaggggtcggactacattggtgaccaggatgccatcgaatatatgtgtaagaccggaccggaagcgattctggaactggagcacatggggctaccgttctcccgtcttgatgatggacgtatctatcagcgcccgttcggcggccagtcgaaaaactttggcggcgagcaggcggcacgtaccgcggcggcggctgaccgtaccggtcacgccttgctacacacgctgtatcaacagaatttgaaaaaccacaccacgattttctccgaatggtatgcgctggatctggtgaaaaaccaggatggcgcggtggtggggtgtaccgcactgtgcatcgaaaccggtgaagtggtgtacttcaaagcccgcgcgacggtgctggcgaccggcggcgcaggccgtatctaccagtccaccaccaacgctcacatcaacaccggtgacggtgtcggtatggcgctgcgtgccggtgtcccggtgcaggacatggaaatgtggcagttccacccgaccggcatcgccggggcgggcgtgctggtgacagaaggctgccgcggcgaaggcggttacctgctgaacaaacacggcgagcgctttatggagcgttatgcgccgaacgccaaagacctggcgggtcgtgacgtggtggcgcgttccatcatgatcgaaatccgtgaaggccgcggctgtgatggtccgtgggggccgcacgctaaactgaaactggatcacctgggtaaagaggtgctggaatctcgcctgccgggtatcctggagctgtcccgtactttcgcccacgttgacccggtgaaagagccgattccggttatcccgacctgccactacatgatgggcggtattccgactaaagtgaccggtcaggcgctgaccgtgaacgagcagggcgaagacgtggtcattccggggctgtttgcggtaggcgaaatcgcctgtgtatcggttcacggcgccaaccgtctgggcggtaactcactgctggatctggtggtctttggccgcgcggcggggctgcatttacaggaatccatcgccgagcagggcgtgctgcgcgacgccagcgagtctgacgttgaaggttctctggagcgcctgaatcgctggaacaataaccgcaatggcgaagatccggtggctatccgcaaagcgttgcaggagtgtatgcagcataacttctccgtattccgtgaaggcgacgcgatggcgaaagggcttgagcagttgaaagtgatccgcgagcgtctgaaaaacgcccgtctggatgacacgtccagcgagtttaatacccagcgtgttgagtgtctggagctggataacctgatggaaaccgcctacgccactgccgtatcagccaacttccgaacggaaagccgcggcgcgcatagccgcttcgatttcccggagcgtgatgatgccaactggttgtgtcataccctgtatcagccgcaaacggaatccatgacgcgccgaagcgtcaatatggagccgaaactgcgtccggcgttcccgccgaagattcgtacttattaattgcggagacaggatgatgaaactcgaattttcgatttatcgttataacccggatgtcgataacgctccgcgtatgcaggattacaccctggaaggcgaagaagggcgcgacatgatgctgctggatgcgttaatccagcttaaagaaaaagatcccagcctttctttccgccgttcctgccgcgaaggtgtgtgcggttctgatggtttgaatatgaacggtaagaatggtctggcctgtattacccctatttcggcgctgactcagccgggtaagaagattgtgattcgcccgctgcccggtttgccggtgatccgcgatttggtggtagacatggggcaattctacgcacaatatgagaagattaagccttacttattgaataatgggcaaaatccaccggctcgtgagcatctgcagatgccggagcagcgtgaaaaactcgatgggctgtatgaatgtattctttgcgcctgttgctcaacatcctgcccgtcattctggtggaacccggataagtttatcggtccggcggggctgctcgcggcgtatcgattcctgatcgatagtcgtgataccgagactgacagtcgtctggaagggatgagcgatgcattcagcgtattccgctgtcacagcattatgaactgcgtcagtgtatgtcctaagggactgaacccgacgcgcgctatcggccatattaagtcgatgctgttgcagcgtagcgcataagtagttgtagtggttgccggatggcgacgtacagtcttatccggcctacaggcgcaaccccgtaggcctgataagcgcagcgccatcaggcaatagaagtgcaggaaacctctaaaaactgccatatgattagtaataatcgagatgttcagagcgagacaaggcgcggtctgaacgaatcttcgggagcatagttaactatgtgaccggagtgagcgaaggccgcaacgcagtcgtagcctgaacagcgaagattattagacagtttttaaaggttccttagcggacgcagatgacacgacagtccgcaacaagtgaaccccggcacgcatacagcgtatgcgtggttagtatccacggcgaaatactcgtcatagttcacgttgcatgtgcgttggctgcacttgctcaccccggtcacttactggatgtaagctcccagggattcgcaagcttgccgccttcctgaaacgtgacctatttagagtattaaataagcagaaaagatgcttaagggatcacgatgcagaacagcgctttgaaagcctggttggactcttcttacctctctggttcgaatcagagctggatagaacagctctatgaagacttcttaaccgatcctgactcggtagacgctaactggcgtttgacgttccagcagttacctggtaccggagtcaaaccggatcaactccattcaaaaacacgtgaatatttccggcggcaggcgttggctggctcacgtcactcttctacgatttccgaccctgacaccaatgtgaagcaggttaaagtcctgcagcttatcaacgcttatcgtttccgtggccatcaacatgcaaacctcgatccgctgggactgtggaagcaagaacgcgtggcggatctcgatccttctttccatgatttgaccgaggccgatttccaggaaaccttcaatgtcggctcctttgccagcggcaaagagacgatgaagctgggcgagctgctcgacgcgctcaaacagacctactgcggcccgattggcgctgagtatatgcacatcaccagcaccgaagagaaacgctggatccaacagcgcatcgaatccggtcgtgcggcctttagcgctgacgagaaaaaacgcttcctgaacgaactgaccgccgctgaagggctggaacgttatctgggcgccaaattcccgggtgcgaaacgtttctcgctcgaggggggagatgcgctgatacccatgctgaaagagatggttcgccatgcgggtaacagcggcactcgcgaagtggtgctggggatggcgcaccgcggtcgcctgaacgtgctgatcaacgtactgggtaaaaaaccgcaggatctgttcgacgaatttgccggtaagcataaagaacatctgggtaccggcgacgtgaagtatcacatgggcttctcgtcagatatcgaaaccgaaggcggtctggttcacctggcgctggcgtttaacccatcgcatctggaaattgtgagcccggtggtgatgggctccgtgcgcgcccgtctggacagactggacgaaccgagcagcaacaaagtgttgccgatcactattcacggcgacgccgcggtgaccggccagggcgtggttcaggaaaccctgaacatgtcgaaagcgcgcggttacgaagtgggcggtacggtacgtatcgttatcaacaaccaggtgggtttcaccacctctaacccactggatgcgcgttcaacgccttactgcaccgatatcggtaaaatggtccaggcgccgattttccacgtcaatgcggacgatccggaagccgtcgcttttgtgacccgtctggcgctggacttccgtaatacctttaaacgcgatgtctttatcgatctggtgtgctaccgccgtcacggccacaacgaagccgacgagccaagcgcaacccagccgctgatgtaccagaaaatcaaaaagcatccgacgccgcgtaaaatctacgccgacaaactggaagctgataaggtcgcaacgctggaagatgccactgaaatggtcaacctctatcgcgatgcgctggatgcaggcgaatgcgtggtgaaagagtggcgtccgatgaatatgcactcgttcacctggtcgccgtatctaaaccacgaatgggatgaagcatacccgaacaaggtagaaatgaagcgtctgcaggagctggcaaaacgtatcagcaccgtgccggaagccattgaaatgcagtctcgcgtggcgaaaatttatggcgaccgtcaggcaatggcggcaggcgagaaattgtttgactggggcggcgcggaaaatctggcttacgccacgctggtcgatgaaggcattccggtgcgcctgtccggggaagactctggtcgcggcaccttcttccatcgtcatgcggtgatccacaaccagacgaacggctcaacgtatacgccgttgcagcatattcacagcggtcagggacagtttaaagtctgggactccgtgctgtctgaagaagcggtactggcttttgaatacggttatgccacggcggaaccacgtaccctgactatctgggaagcgcagtttggcgattttgccaacggcgcgcaggtagtgattgaccagttcatctcctccggcgagcagaaatggggccggatgtgcggtctggtgatgctgttgccgcatggctatgaagggcagggcccggagcactcttccgcgcgtctggaacgttatctgcaactttgcgccgagcagaatatgcaggtttgcgtgccgtccaccccggcgcaggtctaccatatgctgcgccgtcaggcgctgcgcgggatgcgtcgtccgctggtggtgatgtcgccgaaatcgctgctgcgtcacccgctggcggtttccacgcttgatgaactggcgaacggttccttccagccggccattggcgaaattgacgagctggaccctaaagccgtaaaacgcgtggtaatgtgttctggtaaggtttattacgacctgctggaacaacgtcgcaaaaacgaccagaaagatgtcgctatcgtgcgcatcgaacagctctatccgttcccgcataaagcggtgcaggaagcgctgcaaccatacgctcacgtccatgattttgtctggtgccaggaagagccgctcaaccagggcgcatggtactgcagtcagcatcatttccgtgaagtgactccgtttggggccgctctgcgttatgcaggtcgcccggcctccgcctctccggcggtagggtatatgtccgttcaccagaaacagcaacaagatctggttaatgacgcgctgaacgtcgattaaataaaggataaataatgagtagcgtagatattcttgttcccgacctgcctgagtccgtagcggacgcgaccgtcgccacctggcataaaaaaccgggcgatgcggttgttcgtgacgaagtgctggtagaaatcgaaactgacaaagtggtactggaagtaccggcatcagcggacggcattctggatgcggttctggaagaggaggggacgactgtcacctctcgccagatcctgggtcgcctgcgtgaaggaaacagcgcgggtaaagagaccagcgcgaaatctgaagagaaagcgtctacgccggcacagcgccagcaggcgtcgctggaagaacaaaacaacgatgcgctcagcccggcgatccgtcgcctgctggctgaacacaatctggaagccagcgccattaaaggcactggtgtgggtgggcgtctgacccgtgaagatgtggaaaaacatctggcgaaaggcgagtctaaagcacccgctgttgaacctgcagcacaacccgctctgggcgcgcgcggcgaaaaacgcgtgccaatgacccgcctgcgcaagcgcgtggccgagcgtctactggaagcgaaaaattccaccgccatgctgacgaccttcaatgaagtcaacatgaagccgattatggatttgcgtaagcagtatggcgaagtgtttgaaaaacgtcatggtatccgcctgggctttatgtccttctacgtgaaagcggtagtggaagcgctgaagcgttatccggaagtgaacgcctctatcgacggcgatgacgtggtgtatcacaactactttgatgtgagcatggcggtgtctacgccgcgcggcctggtcacgccggtcctgcgtgacgtggatacgctgggcatggctgacatcgagaaaaaaattaaagaactggctgtcaaaggccgcgacggcaagctgaccgtagaagacctgaccggtggtaactttaccattaccaacggcggcgtattcggttcgctgatgtctaccccgatcatcaacccgccgcagagcgcgattctgggaatgcatgctattaaagacaggccgatggcggtggatggcaaggtggaaatcctgccgatgatgtacctggcgctctcttacgatcatcgcctgatcgatggtcgcgaatccgtgggcttcctggtcaccatcaaagagttgctggaagatccgacccgtctgctgttggacgtgtagtcagcaagagcatcacctgctacctgtaggccggataaggcgttcacgccgccatccggcgatggtgtaatgcctgatggcgcgcagctttcaggcctacaggtctaaagataacgattacctgaaggatggacagaacacatgaacttacatgaatatcaggcaaaacaactttttgcccgctatggcttaccggcgccggtgggttatgcctgtactactccgcgtgaagccgaagaagccgcgtctaaaatcggcgctggcccgtgggtagtgaaatgtcaggttcacgctggcggccgcggcaaagcgggcggtgtgaaggtagtaaaaagcaaagaagagattcgcgccttcgcggaaaactggctgggcaaacgtctggtgacctatcaaacagacgctaatggccaaccggtaaaccagattctggttgaagcggcgaccgacatcggcaaagaactgtacctcggcgcggtagttgaccgtagttctcgtcgcgtggtctttatggcgtctaccgaaggtggcgtagagatcgaaaaagtcgcggaggaaaccccgcatctgatccataaagtcgcgctcgatccgctgaccggcccgatgccgtatcagggacgggaactggcgttcaaattgggtctggaaggtaaactggtgcagcagttcaccaaaatctttatgggtctggcaaccattttccttgagcgcgacctggcgctgatcgaaatcaacccgctggtgattactaagcagggcgatctgatttgcctcgacggcaagctgggcgctgacggcaacgcgctgttccgccagccggatctgcgtgaaatgcgtgaccagtctcaggaagacccgcgtgaagcgcaggcagcgcagtgggaactgaactacgtcgcgctggacggcaacatcggttgcatggtgaacggcgcgggtctggcgatgggcaccatggacatcgttaagctgcatggcggcgaaccggctaacttccttgacgtgggcggcggcgcaaccaaagagcgcgtcaccgaagcgtttaaaattatcctctcggatgacaacgtgaaagcggttctggttaacatcttcggcggtatcgtccgttgtgacctgattgccgacggtatcatcggcgcggtggaagaagtgggcgtgaacgttccggtggtggtgcgtctggaaggcaacaacgccgaactcggcgcgaagaaactggctgacagtggcctgaatattattgcagcgaaaagtctgacggatgcagctcagcaggttgttgccgcagtggaggggaaataatgtccgttttaattaataaagataccaaggttatctgccagggcttcaccggtagccaggggactttccactccgaacaggcgattgcttacggtacgcagatggtgggcggcgtaacgccgggcaaaggcggcaccacgcatctggggctgccggtgttcaacaccgtgcgcgaagcggtagaagctaccggtgcgaccgcatccgttatctacgtcccggcgccgttctgcaaagactccatcctggaagcgattgacgcaggcatcaaactgattatcaccatcaccgaaggtattccgacgctggatatgctgaccgtgaaagtgaagctggacgaagcaggcgtgcgcatgatcggcccgaactgcccaggtgtgatcaccccgggcgaatgcaaaatcggcatcatgccgggtcacattcataagccgggtaaagtgggtatcgtttcccgttccggcacgctgacctacgaagcggttaagcagaccaccgactacggtttcggccagtccacctgcgtgggtatcggcggcgacccgattccgggctctaactttatcgatatcctgaaactgttccaggaagatccgcagactgaagcgatcgtgatgatcggtgagatcggcggtagtgcagaagaagaagcggcggcttacattaaagaccacgtgaccaagccggttgttggctatatcgcgggtgttaccgcgccgaaaggcaagcgtatgggccacgcgggcgccatcattgccggtggtaaaggcactgcggatgaaaaattcgcagcgctggaagccgcgggcgtgaaaaccgttcgcagcctggccgatatcggcgaagcgctgaaagcaattataaaataaaactcgctgttcctgcgggaacagataaatgtccgttttcgacatggttggccacctttacggtggccttttttatggctttattgtttgtggcaaagtacgggtgaagcatccgggatataaaattattggctttgtaaatactgaactataggaaaataatgcctcattaaaaaaacatggtggagtctaaaaataattgataataaccgtctggcagcggcagtaaatttactcagtttgctggttaactcttttgcagcaaatacagatgctgtcttagtgaaatacctgccgacctcactggagacggattatgcgctttccgccatgaaaaaaacgcattgcagcattacactatgttgacgctaacctctatagtaaattgacgcttgactctgtggccgcgcatgtttgcctgagcgcgaactacatgtctcctcagatgtatcgcgcttacacagactgcttgtttaatggcagaataaaacagctattttaatcataagagtaccgacattatttccatgaagtattaaagatatcgtttaataaatcatatgaacttttgctggttaaaagaggttaactttaaaaattattaagaacttattgacactattcgttcgtgattaatcatgtttaaaggatatttatggctgcgaataaacagaattatcactatgagtgacgtagaaattgagggtgaatctgtgaaggtgataacagaatcttcgctataataattatagagaggtaaatacggtgttattgaaataaagaaaaattagcgaataaaatgtttgtttctggctatctggaaagcttattagcgataattaaggcgataacctggcaagatgagcctggccattagtcgtcgggaaagggaagttggggcagggtaatcccggtgggatgatggcgcgtgtgcaatgagatagtttctttgctgtgttaattataagtaaaataaaaatagactaaatgtataaaataataagtattgataacctgcagaaaaaatctgtgagctatttagcaataattgaacatcaatgtggaatgttttttactggatgcggggcagtaaaaaacgcacaaaatgtttagccttatcgaataagtctatttttacagggggtttgaaattactctttgcaaaaacaaaaagttaacaaaaaattcaccatgcattcaatgaataaacattattaacattaacttcaaaaattgattttaatcaatatttaaatgttggaaaagagcatcaaaactggttaaattgtccgtgatcaaattccctgaaaagcgatagattagccataaattgatcgctgtcgaaaaaagcaaatctgacccactaaaaacctgtttattgtaagggttttacggcgtaatatatttgcgggatcaatttgggttttttattaacatgtttgtaacttttcatcattactgtttccttcccgaggggatagtacgatggaaggccgcaaataaatttgtattggggcatgcgtgtgaccctttctaacggggttcactctcggagtcttcatgcgatgagcaaggagtcatgatgttagatatagtcgaactgtcgcgcttacagtttgccttgaccgcgatgtaccacttcctgtttgtgccgctaacgctcggtatggcgttcctgctggccattatggaaacggtatacgtcctttccggcaaacagatttataaagatatgaccaagttctggggcaagttgtttggtatcaactttgctctgggtgtggctaccggtttgaccatggagttccagttcgggacaaactggtcgtactactcccactatgttggggacatcttcggtgcgccgctggccatcgaaggtttgatggccttcttcctcgaatccacctttgtaggtctgttcttcttcggctgggatcgtctgagtaaagttcagcatatgtgcgtcacctggctggtggctctggggtccaacctctccgcgttgtggattctggtagcgaacggctggatgcaaaacccaatcgctgcggatttcaatttcgaaaccatgcgtatggaaatggtgagcttctctgaactggtgctgaacccggtagcacaggtgaaatttgttcacactgtggcgtccggctatgtcaccggcgcgatgttcatcctcggtatcagcgcttactacatgctgaaaggtcgtgacttcgcctttgctaaacgctcctttgctattgccgccagcttcggtatggctgccgtactgtccgttatcgtactcggcgacgaatccggttacgaaatgggcgacgtgcagaaaaccaagctcgctgcgattgaagctgaatgggaaacgcaacctgctccggcctcctttaccttgttcggtattcctgaccaggacaaacaggaaaaccatctggcgattcagatcccttatgcgctcggtattatcgctacgcgttccgtggacacgccggttattggcctgaaagatctcatggttcagcatgaagagcgtatccgtaacgggatgaaagcctatgaactgctggagcagctgcgcgccggttctaccgaccaggccgttcgcgaccagttcaacagcatgaagaaagatctcggttacggcctgctgctgaaacgctatacgcctaatgtgactgacgcgaccgaagcgcagatccagcaagcgacgaaagattccattcctcgcgttgcgccgctgtacttcgctttccgtatcatggtggcgtgcggcttcctgctgctggcgatcatcgcactttccttctggagcgtgattcgtaaccgcatcggtgagaaaaaatggctgttgcgcgcggcgctatacggtattccactgccgtggattgcggttgaagcaggttggttcgtcgccgagtatggtcgtcagccgtgggcgatcggcgaagtgttgccgacagccgtagcgaactcatcgctgaccgtgggcgatctgctgttctccatgttcctgatttgcggcctgtataccctgttcctggtggcagaattgttcctgatgttcaaatttgcacgccttggcccaagcagcctgaaaaccggtcgctatcactttgagcagtccaccgtgacttctcagccggcacgctaagacaggagtcgtcaaatgatcgattatgaagtactacgttttatctggtggctgctggttggcattttgctaattggtttcgctgtcaccgatgggttcgacatgggggtggggatgctcacccgtttcctcggtcgtaacgacaccgaacgtcgaattatgattaactctatcgctccacactgggacggtaaccaggtgtggttgatcaccgcgggcggtgcgttgtttgctgcctggccgatggtttacgccgcggcgttctccggtttctatgtggcgatgatcctggtgctggcgtctttgttcttccgtccggtcggttttgattaccgttccaagattgaagacccgcgctggcgcaacatgtgggactggggcgtgttcatcggtagctttgtgccgccgctggtgattggcgtggcctttggcaacctgttgcagggcgtaccgttccacgtggatgagtatctgcgtctgtactacaccggtaacttcttccagttgctgaacccgtttggtctgctggcgggtatcgtaagcgtagggatgatcatcacgcagggggcgacttacctgcaaatgcgcaccgttggcgaactgcacctgcgcgcgcgcgccacctcgcagattgcggcgctggtgacattagtgtgctttgcgctggcgggcgtttgggtaatgtatggtattgatggttatgtcgtgacatccgcgattgatcatcatgccgcctctaacccgctgactaaagaagtggcgcgtgaagctggcgcctggctggtgaactttaataatgctccgatcctgtggttggttccggctctgggcgtggttctgccgctgctgactatcctgacttcccgtatggagaaaggcgcgtgggcattcctgttctcttcgctgaccctggcctgcattattctgacggcgggtatcgctatgttcccatttgtgatgccgtccagcacgatgatgaatgccagcctgaccatgtgggatgcgacatccagccagatgacgctgaacctgatgacctgggttgcggcggtgttcgtaccgatcattctgatctacaccagctggtgttactggaaaatgttcggtcgtatcactaaagaacatattgaaagcaacacccactctctgtactaagtaaggagcttaaaatgtggtatttcgcatggattctgggaacgcttcttgcctgtgcattcgggatcattaccgccctggcgcttgagcacgttgaagcgggtaaaaccggtcaagaagaaagctaatgattcatattgtcgctatgcaatatacaaaatcatttaagttgcatcgcggcggcaaggctgcgaatccccaggagcttacatcagtaagtgactggggtgtgcagccgcagccaacaaagaggcagcttagaggatgaagtatatttatgcggtaatggacaagcgcccgttaagggcgctttccttcgtgatggcgatagtgctggcaggatgtatgttctgggacccgtcacggtttgccgccaggaccagcacgcttgaaatctggcacggattattgctgatgtgggcggtttgcgcaggcataatccacggtgtgggttttcgccctgaatccgtacactggcaagggattttttgtccgctccttgcggatatcgtccttatcgtcggcctgattttcttcttcttgtgaataagaaacctccttaaaaatataggggcttgcataagcccatatatttttactctcccttaacttccccccattcccaagcctcattcccacgcgtatagtagcaacgtttaaaagctctacttttgttgcattaccgggatgtaaagtgaatacaaggcgatatacaacggcattcttgaggcattacggcggcaagcggatgacgccaacaaagaggctgcagggatgaataagtatatgtttcgatggccaattcgagtttattacgaagacacggacgccggcggtgtggtttatcacgccagctatgtcgctttttatgaaagagcgcgcacggagatgctgcgtcaccatcacttcagccaacaggtgctgctggcggagcgggtcgcctttgtggtgcgcaagatgacgctggaatactatgcgcctgcgcggctcgacgatatgcttgaagttcaaacagaaattacgtcaatgcgtggcaccgctttggttttcacgcaacgcattgtcaacgcagagaacacgctgctaaatgaagcagaggttctgattgtttgcgttgatccactcaaaatgaagcctcgtgcgcttcctaagtctattgtcgcggagtttaagcagtgactgacatgaatatccttgatttgttcctgaaggcaagccttctggttaaacttatcatgttgattttgattggtttttcaatagcatcctgggccatcattatccagcgaacgcgtattctgaacgccgctgcgcgtgaggcggaagcgtttgaagataaattctggtccggaatcgaactatcgcgtctgtaccaggaaagccaggggagacgcgatagtctgtcgggctcggaacaaatcttttatagcgggttcaaagagtttgtccggctccatcgcgccaacagccatgcgccggaggcagtggtagagggggcgtcgcgtgcgatgcgcatctccatgaaccgagagctggaaacgctggaaacgcatatcccgtttcttggcacggtaggctctatcagtccttatatcggtctgtttggcaccgtatgggggattatgcatgcgtttatcgccctgggcgcggtgaaacaggcgactctgcaaatggttgcgccgggtattgccgaagcattgattgccacggcgattggtctgtttgccgccatccctgcggttatggcttacaaccgactgaatcagcgcgtgaacaagctggaactgaattacgacaactttatggaagagttcaccgcgattctgcaccgccaggcgtttaccgtaagcgaaagcaacaaggggtaagccatggccagaacgcgtggacgaggtcgtcgcgaacttaagtccgaaatcaatattgtaccgctgctcgacgtactgttggtgctgctgctgatctttatggcaaccgcgccgatcattacccagagcgtggaagtcgacttgcccgaggcgaatcagtcgcaggcggtcagtagtaacgacgatccaccggtcattattgaggtttccggagtagggcaatacagcgtagtggttgataaagatcgaatggatcaactgccgtctgaacaggtgatcgcagaagtaaagcgtcatctgcaggctaatccgaaaacagtctttttaatcggcggcgcgaaagaggtgccgtacgatgaaataattaaagcgctgaacttgttacacagcgcgggcgtaaaatcggttggcttaatgacgcagccaatctgaagtctgcgtcccgttggcttgaaagacggcgagtaacaggcgaacagttttttgggaaccgagagtgtcaaaggcaaccgaacaaaacgacaagctcaaacgggcgataattatttcagccgtgctgcatatcatcttatttgcagtgctgatctggagttcgtttgatgagcatatagaggcttctgccggcggcggcggtggttccgctatcgacgcggtgatggtcgatcctggcgccgttgtgcagcagtacaaccgtcagcaggatcaacaggccagcgccagacgcgcggaagaagagcgtaaaaagctgcaacagcagcaagcagaggagctgcagcagaagcaggctgctgaacaggagcggttgaaacaacttgagaaagaacgtttagcggctcaggagcagcaaaagcaggctgaagaagcggcaaaactggcgcaacagcagcagcaacaggccgaagaagcggcgaaagcggcggcggacgcgaagaaaaaagcggaggccgaggcggcgaaagcggcggcggacgcgaagaagaaagcggaagccgaagcggtaaaagcggcagcggacgcgaagaagaaagcggaagccgaagcggcgaaagcggcggcggacgcgaagaagaaagcagaggccgaagcggcgaaagcggcggcggaggcgaagaagaaagcggaagccgaagcggcgaaagcggcggcggaggcgaagaagaaagcggatgccgaggcggcgaaagcggcggcggaggcgaagaagaaagcggatgccgcggcggcgaaagcggcggcggaggcgaagaagaaagcggatgccgcggcggcgaaagcagcggcggacgctaagaagaaagcggctgccgaaaaagcggccgccgcagaaggcgtcgacgatctgcttggcgatctcagctcgggtaagaatgcgccgaaaaccggcggcggcgcgaaagggaatggtcagccatcgaaagatagcggtacatcgggcgctaacggtggggcgacaggcgctgatatcagcgcctacgcgaaacagattcaggtcgccattcagagccgtctgtacgatgcgagcctgtatcagggcaaacaatgtgtcttgcatattagcctggcgccggatggctcattaaaaagcattacgtctgagggcggcgatccggcgctttgtcaggcggcgttaatggcggcaaaaaccgcgaaaattcctaaaccgccaagccaggctgtttatgagaaaataaaggatgccaaactagactttaaactgtagatacttttctttatggaagttagagcagttgagttgttactggtcctggtggttttgtgtatttgagtttgttaacattctgctaaattatcgtgggtcgcaggcccaggtatgggagatatgatgaagcaggcattacgagtagcatttggttttctgatgctgtgggcggcggtgctgcacgcagaagtccgtatcgagatcacccagggggtggactcggcgcgaccgattggcgttgtgccttttaaatgggccggaccgggcgctgcgcctgaagatatcggtggcatcgtggcggcagatttacgcaatagcggtaaatttaatccgctagaccggtcccgactgccgcagcagccagccaccgctcaggaagttcagcctaccgcatggtctgcgctgggtattgatgccgtcgtcgttggacaggtaacgccgaatccggacggttcctacaatgttgcttatcagctggttgacactggcggcgcgccggggactgtactggcgcaaaattcttataaagtgaacaagcagtggctgcgttatgcaggtcataccgccagtgacgaagtctttgaaaaactgacgggcattaagggcgcgttccgtactcgtatcgcctatgtggtacagactaatggcggtcagttcccgtatgaactgcgtgtgtcggattacgatggttacaatcagtttgtggtgcaccgttctccgcagccgttgatgtctccggcgtggtctccggacggctcaaaactggcttacgtgacatttgaaagcggtcgctccgcgctggttatccagacgctggcaaacggcgcagtgcgtcaggttgcgtccttcccgcgtcacaacggcgcgccggccttctcgccggatgggacgaaactggcgttcgcgttatcgaaaaccggaagtctgaacctgtacgttatggatctcgcctccggtcagattcgtcagataacggacggccgtagcaacaatacggagccgacctggttcccggacagccagactctggcctttacctctgaccaggctggacgtccgcaagtgtataaaatgaacattaacggcggtgcggcgcagcgtattacctgggaaggttcgcaaaaccaggatgcggatgtcagcagcgacggtaaatttatggtaatggtaagctcaaataacgggcagcagcacattgccaaacaagatctggtgacgggtggcgtacaggttctgtcgtcaacgttcctggatgaaacgccaagtctggcacctaacggcacgatggtaatctacagctcttctcaggggatgggatctgtgctgaatttggtttctacagatgggcgtttcaaagcgcgtcttccggcaactgatggtcaggtgaaatcgcctgcctggtcgccgtatctgtgataataattaattgattactaaaggaattaaagaaatgcaactgaacaaagtgctgaagggcctgatgattgccctgcctgttatggcaatcgcggcatgttcttccaacaagaacgccagcaatgacggtagcgaaggcggtatgctgaacggcgccggcactggtatggacgctaacggcaacggcaacatgtcatctgaagagcaagcgcgtctgcagatgcagcagctgcagcagaacaacatcgtttacttcgatctcgacaagtacgatatccgttctgacttcgcggcaatgctggatgcgcacgctaacttcctgcgtagcaacccgtcttacaaagtcaccgtagaaggtcacgcggacgaacgcggtactccggagtacaacatctccctgggtgagcgtcgtgctaacgccgttaaaatgtacctgcagggtaaaggcgtttccgctgaccagatctccatcgtttcttacggtaaagaaaaacctgccgtactgggccacgacgaagcggcttacgctaagaaccgtcgcgctgtactggtttactaagagaattgcatgagcagtaacttcagacatcacctgttgagtctgtcgttactggttggcatagcggccccctgggccgcttttgctcaggcgccaatcagtagtgtcggctcaggctcggtcgaagaccgcgtcactcaacttgagcgtatctctaacgctcacagccagcttttaacccaacttcagcagcagctctccgataatcagtccgatatcgattctttgcgcggccaaatccaggaaaatcagtatcaactgaatcaggtgatggagcgccagaagcaaattatgctgcagctggggagcttaaataatggcggcgcagcgcagccagcagctggtgaccagagcggggcggcaaccactgcgacccccgccccggatgccggtacggcaacctcaggggcgccggtacaaagtggcgatgcgaataccgattacaatgcggcaattgcgctggtgcaggataagtctcgccaggatgatgcgattgtggcgtttcagaacttcatcaagaaataccctgattctacttatcagccgaacgccaattattggctgggccagttgaattacaacaagggtaaaaaagatgacgccgcctattatttcgcctcggtagtaaaaaactatcctaagtcgccgaaggctgcggacgcgatgtacaaagttggcgttatcatgcaggacaaaggtgatacggcaaaagcgaaagcagtttatcagcaggtgattaacaaatatccaggcactgatggcgcgaaacaggcgcagaagcgtcttaacgcgatgtaatgcgtaccatgcgaccagaaaacgccttttttctggtcgcgtcgtgcgattcctaagcagttgagccctctgcgtcgaaatttttgttgcgctcaaatctgaaatcagtaatatatgccgccgttgccacgggatattaaacaactcgaaagcaacgcaaaagtgggtcgttagctcagttggtagagcagttgacttttaatcaattggtcgcaggttcgaatcctgcacgacccaccaatcgttcggtggaaacgagaataaaacgtgaaggataacgttgcgtcagcaacggcctgtagggcgaggcgaagccgagtcatcctgcacaccactaacttcggttagtcagtaatatccagcgtagtatcgggtgattagctcagctgggagagcacctcccttacaaggagggggtcggcggttcgatcccgtcatcacccaccactcgggtcgttagctcagttggtagagcagttgacttttaatcaattggtcgcaggttcgaatcctgcacgacccaccaattttctaattggtgccgagtaaaaatatttcaggtagtcccaccgtatgggtcgttagctcagttggtagagcagttgacttttaatcaattggtcgcaggttcgaatcctgcacgacccaccaatatacaaggtggtaactggtagagaacgtgaaggttaacgttgctttagcaacggcccgaagggcgaggcgaagccgagtcatcctgcacgacccaccatcctgaatgattgaagcagtaacccttatccaaggggtcgttagctcagttggtagagcagttgacttttaatcaattggtcgcaggttcgaatcctgcacgacccaccaatgtaaaaaagcgccctaaaggcgcttttttgctatctgcgatatggaagattcgaacctgccgcaggttcgggtctcacgtagtgagacaacggagccgcttgcggcgacggcccgaagggcgagcaaagcgagtcatcctgcacgacccaccaatgtaaaaaagcgccctaaaggcgcttttttgctatctgcgatatggaagattcgaacctgccgcaggttcgggtctcacgtagtgagacaacggagccgcttgcggcgacggcccgaagggcgagcaaagcgagtcatcctgcacgacccaccaatgtaaaaaagcgccctaaaggcgcttttttgctatctgcaatatgaagattcgaacctgccgcaggttcgggtctcatgcagtgagacaacggagccgtttacggcgacggcccgaagggcgagcgaagcgagtcatcctgcacgacccaccaatgtaaaagagggcgctggcggcgcctttttgctatctgcaatatggaagattcgaacctgtcgcaggttcgggtcttgcctgatgcgctgcgcttatcaggcctacagacggcaccgctcacgtaggccagataagacgttacgccgccatcagatacggggctacgtaattattgtgactttccttattgaatcagctatcttgtttagcatataaaacaaattaaccgattgtggcgtttattacgctttcattcggttgtttcgttaagtcagtaaaacgagaagccacgatgagcgtaatgtttgacccacaagccgcaatctacccgttcccgccgaaaccaacgccgttgaacgacgacgaaaagcaattttatcgtgagaaaatcaagcggttgctcaaagagcgcaatgccgtcatggtggcgcactactacaccgatccggaaattcaacagttagcagaagaaaccggcggctgtatttccgactcactggaaatggcccgtttcggcacgaagcacgccgcatccacgctgctggtagcgggcgtacggtttatgggggaaaccgccaaaatcctcagcccggaaaagaccattcttatgcctaccctggcggcggaatgttcgctggatttaggctgcccaatagacgaatttagcgctttttgtgatgcgcaccctgacagaaccgtagtggtctatgctaacacctcggctgctgttaaagcgcgtgcggactgggttgtgacctccagtatcgccgtagaactgattgagcatctggatagtttgggggaaaaaattatctgggcgccggacagacacctggggaattacgtgcaaaaacagaccggggccgatgtactgtgctggcaaggagcgtgtatcgtgcatgacgagtttaaaactcaggcgttgacccgtttaaaaaaaatctatcccgatgccgctcttctggttcaccctgaatcgccgcagtccattgtcgagatggccgatgcggtgggctccaccagtcagcttattaaggcggcaaaaacgctgccgcacagacagcttatcgtggcgaccgatcgcggcatcttctacaaaatgcagcaggcggtgcctgaaaaagaactgcttgaagcgcccacggctggcgagggggcgacctgccgtagctgcgcgcactgtccgtggatggcgatgaatggcctgaaagccattgctgaagggctggagcagggaggcgcggcgcatgaaatacaggttgatgcggcgctacgcgagggcgcattactgccgctcaaccggatgctggattttgcggctacacttcgggcgtaaagacggaaatctttgggggagagaatggatttttttagtacgcacaacatactgattcatattccgattggcgctggcgggtacgatctctcgtggatcgaagcggtaggaaccatcgccggcctgctctgtatttggcttgccagtctggagaagatcagcaactacttttttggactggttaacgttaccctgtttgcgattattttctttcagatccagctttatgccagcctgttgctgcaactctttttctttgccgccaatatttatggctggtatgcgtggtcgcggcaaacaaaggataatcaagccgagcttaaaatccgctggctgccgttgccaaaagcaatggcatggctggcgatatgtgtgatagctatcggtttgatgacgcgatatatcgatcccgtattcgccgtcctgacgcgcgtggccgtcgccattatgcagatgctggggttacaggtgacaatgcccgtactgcaaccggacgctttcccgttctgggactcttgcatgatggtgctgtctatcgtggcgatgattctgatgacacgcaaatatgtcgaaaactggctcctgtgggtgataatcaacgtgatcagtgtggtgatttttgctttgcagggcgtctatgcgatgtcgctggaatatctgatcctgacatttatcgccgtgaacggtagccgcctgtggataaacagcgcgcgggagcgaggatcgcgcgcgctttcccgttaatggtgatgaacatgcccggacgatgtctgattcagatgacagtccgggccgtgacacacttgatactccatctgaatcgtagcgtgcgcaatatggtattcgtgcatcaggaaatcctggatacgttccagcagcgcatcatggtcgtgtggcggaatgacctgagcgtgcaacgtcatgaccggtttttcgccgaccatccagacatgcacatggtgtacgttgcggacttcggggatttcccgacttaaatggcgctgtaaggcattaatatccagtgaaaccggcgcgccttccagcaattcgttgacgctatcttttaacaaacgccaggcgctgcgtagcaccagtaccgaaaccagaatagagagaatcgggtccgctggcgtccagcctgtccagataatgatcaacgcggcgactattgcgccgacggaacccagcaaatcgcccatcacatgtagcgcggcagcgcgcacgttcaggtttttttcatcgcttccccgatggagaatccagaacgcaaacaggttcgccagcagacccgcaaccgcaatcaccatcatcagattgcccgccaccggacgtggcgtgtaaaagcgctctatcgcttcccagacaatgagaagggtaatgaccaccaacgcaatggcattcacaaaggccgccagtgtggtgagtcttagccagccaaaagtgtggcgaacagtcgggggacgacgggaaaattgaaccgccagcagcgcaaagagaagggccgccgcgtcggtgagcatatgtcccgcatccgccaacaacgccagagagccggagagtatcccgcccaccacctcaaggagcataaatccggcagtgacgataaaggcgaaaagcaggcgacgagcattattatctttcggcaggtgtgaatcggcatgagagtgtgagtgcgccataacgtcattcctttgttattctcatcaatactgtagacatcatactgatttttcgctgataaaataaaaaggagagcgaaagctctcccgttatcagacttttttttgcattactgtgtggtaccgtcggttttggtattcacgtcattattgacgccattaccggtttccacttttttattaatatccgggcagcgaccgtctttacacatggtatttttatgctcttcatccttggtcattccgtcatgattcatggttgaaccgtctggatgctgcatcgtgctgttagtattgccgttggtattgatgtcgttgttattcacatcattcggcgctacattctggcgggcgtccggggcaacctgaccggcatttgccgccgagttcgcctggccattactggattgcgcgttagattcagcagctaacgctgcgccgctggcaaggccgagggtagcggtcagtaaaagcgtagtcagttttgtcattttcataagatgctcctgttatggtggatatgtcggataacctcttccaacagtgcacgtgtcagtcaaatcctcaaataagggataaaaagcgttcgccgccgcgggttaacgcagcagagaatcttgcaataattcataaacagagtggttacagttaaaaagtgtagattagatcccatttttcgctacatttgtgcgtttttttcctgaattccaggattattccgttcaaagtgtaaaagcccgtttacactatttaattgaagagatagattggagggattgcattcattgggataagtacggcaacactggaataaacatgaattatcagaacgacgatttacgcattaaagaaatcaacgagttattacctccggtcgcgctgctggaaaagtttcccgccacggaaaatgcagcaaataccgttgctcacgcgcgcaaagccatccataaaattctcaaaggcaatgacgatcgtctgctggtggtgatcggtccttgttcaattcatgatccggcagcggcgaaagagtatgccgcccgtttgctggcgctacgcgatgagcttcaaggcgagcttgaaattgtcatgcgcgtctattttgagaaaccgcgtaccaccgtcggctggaaagggctgattaacgatccgcacatggataacagcttccagattaacgacggtctgcgtattgcgcgcaaactgctgctggatattaacgacagcggcctgcctgccgccggcgaattcctcgatatgatcacgccgcaatatctggccgatctgatgagctggggcgccattggcgcgcggactactgaatcccaggttcatcgcgaattggcgtctggcctctcttgtccggtcggttttaaaaatggtactgatggcacgattaaagtcgccattgacgccatcaacgccgccggcgcgccgcattgcttcctctccgtcactaaatggggtcattcggcgattgtgaataccagcggcaacggcgactgccatatcattctgcgcggcggtaaagcgccaaactatagcgcgcagcatgttgctgaggtgaaagaaggcctcaccaaagcgggactgacgccgcaggtcatgatcgatttcagccatgccaactcctgtaagcaatttcaaaagcagatggaggtttgcgccgatgtctgccagcagatagcgggcggtgaaaaagcgattattggcgtgatggtagagagtcatctggtagaaggaaaccagagtctggaaagcggtcagccgctgacctacggtaaaagcattactgacgcctgtattggctgggaagataccgatgcgctgcttcgtcagttgtcggcagcggtaaaagcccgtcgcggctaagtttagtttctatcctgtagtgaagtgcaggatagaaaacatattggtccggtaacagcctaccggaccggtattaccaatattaatgtattattatttggcgtacttaggtacttcctgcttctggagagtatttccttccgaatcaattcctacaatgactctatagcggtcaaaatataacttcttaatggattctgttcctaattcttcgtaggcaacaatttctactgatttaacatgttttgtattaattgcagacgctcctccaatcccgagtagcgaaaccccaccgtattttttacaaagctcagcgacataatcagcacgatcgcctttgccaagaaacgcagttgccccttgttgaaacatcatttctacaaatgggtccatacgcgcggccgttgtaggaccgttggagccaataggtaaaccaggtctggcagggcaggggccagcatagtaaattgtttggttttgaaaatcgactggtgatttttctccgttactaagcgctacttcgatttttttatgcgcggcgtcacggcaggtgtaagcaaatccagtgagaaataatatatcgccgaccttaagagttttcgctttctctttagtcaatggtaatgttaattccatcatagcttctccaggtattaaatgatttcactagcgtggcggcttgcattacattggaaattgattgcgactggcagtgcagtgatatggcaaggatagtaatcgacatgcacgcctaacgccgtaatacgcccgcccatacctaaagggccgatccctgtattattcacggcctctaataattcagcttcgagctgggcataaagtggtttagcattgaactcaccaagagggcgtaataatgctttcttcgccatccacgaacagtgatccattgtaccgccaacgccgataccaataatataaggagggcatggattgcctcctacacgacggacagtttccagaacaaaatcttttataccatcaataccatcgccgggaagcaatgttttaaaagttcccatattttcgctaccgccgccctttggcataacggtaattgtcactcggtcaccatcaacaatttcagtatgtaaaattgcaggagtattatcattagtattaatacgttctaatggatctgcaaccatggattttcttaagtatccattttcatagccctggcgaacaccctggttcacctgatctttaagcggcttaccttcccagcatacatgttgtccaatttccattataacgatacaagtgccggtatcatggcagcatgcaagttgttctttttttgcatactctccattatcaattaatatcttaatggtttccttgccgatctttgactcttctttatcatatgctttacgaaaagaacacatgagattatcatccagttcataacaagctttttttacaagtttttcgataatcggaatgataatttctgtatttaatatacgactcatactccctccagtgctatgttgcattgttttatccattgatcacattttcatgatattcgtattcattgtaggaaggaaatatgttatttttattaaatgataaattttatttatagtagtggaaaatagatggaaattagacaattagaatattttgtaagcgcttctttgttaggtaacttaaccagagttgctgagcggcattttgtttctcaacctaatatcaccattgctattaagaagttagagactgaattaggggtgacattatttgatagaaagaaaaataaacttgtccttactgaggagggcatgtttttcttacaaaaaattgaacctatccttattgcgttaaaaaatagcgtagcggaaatgaaagattatcgtaatgaaaatggtggcatagtaactttggggatcccaccgatgataagtttgtttcttttttcaccgctcttcaagcatttccgagagatttatccagagatggaactctctcttgttgaagaggggacttttggtttacatgataaactttctgctggagagctggatcttgctattgttattattaatgactgtccaaaagaattagttacggtaccattaatgactcagcagcacgtggtatgtatgtcagataaacatcctctggcaaaaaaggatagtatcgattgggaagatctacaatatgagccattgatactaatgaaaaaagattcctggcatagaaaaacgattattgaagaatgtacaaagcgaggaattcatacacatatttttctatcatcaaacagggttcaaaccaacatagatctggttgctaaaaatgaaggaatttctttcattttggacgctgtcgatcttaaagccgaaaaagtaataaccaaggccatgactgagccgacttatgttacgattggtttggcctggaagaaagataaatatttatcatatgcaaccagagcgttaattaaattcattgaggattatattaaagaacattttacaattaaataattatatttgttcttcaacaaaaatttcccatagctcttcggcatctggaggcattctcttggctggtctataaagtcttatttctatgggtacccataaattactttctttttccgctgcagtaacaatagttttagcctctatatcttgcctggcaaggctttgaggtatccaggcaacaccatcgccagatctgaccattgccaatagtgttgctgccagatcggccacaaaggcaacatttatattatgggtaattctgttaatagacgctgtatttgctattattcttcccagacctgattgtgatgaaaaagaaaggtaagggaattgaatcttattatttatattccacaacggttttaacgtttctgagtctggtttactgaatggaattaatgtatcaaacccaagacgaatgctcataaagttatttttatttaaatttagatgcatatgtgggtgatggtgacacagcaaaaattgtgaatctccctgccgcatcattttttcgcacgcattcaatgagtcagataaaagacgaaatgaaccaaattttgcaattttatcactctgttttaacaaatgcggtacaaaagagaaagacaaagcatgcgttgctgaaaaaacaagactgggttgtttattacctgcggcctcaagggtatcacttttcaatgtgtacaaggagtggatcagttcgggaagctggtctgtaaatacttctccggccttggtaagggtgactccccgtttacttctttcaaaaaggggcgtacccacccattcttcgagagattgtatccgacgactaaatgcgggttgagtcacatatcttgaggcagacgcttttgagaaattcaacgtttcttttagagccagacagtcttcgagccatgttagttcgaggtgatgccgatattgcataagctgcaaccttattagcattggatgagtttcatttatataagtagcattatacacagacagattttaagaggaaattatttgattaaacagaaacaaaagcagtaagaatatgttatgcctttgtcgggtaagtgttgttatttatgtgagtgtattctttctcaatagaaattaattagatgtaattttagtataacatgtgatttatgcttgttgcagttgtattcatgactgtaatgagttgtttttgtaccctaataatataaggacgtatacatgtcaccagcgattattactttgttggttttagtggttgcaataattatctttgttagcgatcgtcttcctatgggattagttgcatttatggtcccaatggcactttattttaccggtgttatcgatgctaaggatatttttgcttcaatcgtaaatgcgaatgttattcttatcgtcgccatgtgtgtactcggtgcggcattttttaaaacaggtttggcatggcaatcaagtaaaattttactaaaatatgctaaaacagaaagaagccttagtgtattgatttttcttattggtggagttatgtctgcctttgtttctaatagcggaacagttgctgtgctaattcctattgttttaggtattgccgccagtagtcagattaagcctattaaacttcttatgcctctggtttttggggcaacaatcggtgctgatatttctattatcggttcgccaggaaatctgattgctaaaaatactattgaaacttttagtaagggaagtctgtcggtgccatttttcgaatacgctaaaattggtattcctttgctgattgcatgctctatatttctctatttcttcggttcaaaactcatcgcagatcgtgatggaaatacacaatctgattctcaaatggattatagccaaattccggcctggcatagaaatttaactttagccgtttttattctgtctatcgctggaatggtggcaactgattatattaagtttctgcctccaatgcatattattgcgtgttgtgcggctattgttcttgtatttgctggcgttttgacacaaaaggaaacttttaattcttttgaaacactaactgttttcatgcttgcgtttatgatgcctttaggagccgcgcttaattctactggtgctggagaaatgattgctaatgccgttatttcagtaaccggagattctggcgttatgattattatggcgtcattgtggatacttacatgggctttgactcaagttatgagtaacactgcagcatgtacgttgttatgcccggtaggatggactatcgcacagtctattggcgcagaccctcgtgcagttgttattgctgtttttattgcgagtagtgttgctgtttgtaccccaatggctattacagcaaactcaatgattattggcccggggaatgttaaatttaaagattttttaaaacccggattggcgattagtttggtttgttttatcgttagtatgattttactaccgatattttatcccttctattaatgcctgatattacttttctattttagattattaaatttgagactttattatgaatagttcggtgctattaggtgaaggcttcaccctgatgttcctcggcatggggttcgtgctggcgtttctgttcctgctgattttcgccatccgcggcatgtccgccgccgtcaaccgcttcttccctgaaccggtcccggtaccgaaggcggcacccgccgccgcgcccgcggacgacttcgcccgcttaaagccggtgattgccgccgctatccaccaccatcgccgccttaacccttaattcacggaggaatccatgaccgttgccattaccgatgtcgtcctgcgcgacgcccaccagtccctgttcgccacccgcctgcgccttgacgatatgctgccgattgccgctcagctcgacgacgtgggctacggctccctcgaatgctggggcggcgccacctttgacgcctgcatccgctttctcggcgaggacccgtggctgcgcctgcgcgagctcaaaaaagccatgccgaagactcccctgcagatgctgctgcgcggccagaacctgctcggctatcgccactacgccgatgacgtggtggaacgcttcgtcgaacgcgccgtcaaaaacggcatggacgtgttccgcgtcttcgatgccatgaacgacccgcgcaatatgaaaccgccctgcaggcggtgcgcagccacggcgcacacgcccagggcacgctctcctacaccaccagcccggcgcacaccctgcagacctggctggatttaacggagcaactgctggaaaccggcgttgactcgattgccatcaaggatatgtccggcattcttacaccgatggcggcgtatgagctggtcagcgaaatcaaaaaacgttttgaggtacgcctgcacctgcactgtcatgccaccaccggcatggcggagatgacgctgctgaaagccattgaagcgggcgtcgacggcgtggacacggcgatttcctccatgagcgccacctacggccacccggccaccgaagcgctggtggcgacgttggcaggtactgagcacgacaccgggctggatatcctgaagctggaaaatatcgccgcctacttccgcgaggtgcgcaaaaaataccacgcctttgaaggccagctgaagggctacgacagccgcattctggtggcgcaggtaccgggcgggatgctgaccaacctggaaagccagctgaagcagcagaacgcggcggacaaactcgaccaggtgctggcggaaatcccccgcgtgcgcgaggacctcggctttatcccgctggtgacccccacctcgcagattgtcggcacccaggcggtgctcaacgtgctgacgggcgaacgctacaagaccattgccaaagaaacggccggcattctgaaaggcgaatacggccacacgccggtgccggtgaacgccgcgttacaggcccgcgtgctggaagggggcgctccggtgacctgccgcccggcggatttactcaaaccggagctggctgaactggaagcggacgtcaggcgtcaggcgcaggagaagggcattactctggcgggaaacgccattgacgacgtgctcaccgtggcgctgttcccgcagattggcctcaaattccttgagaaccgccacaacccggcggcgtttgagccactgccgcaggcggaagccgcgcagccggtggcaaaagcagagaagcctgcagcttccggtatctacaccgtggaagtggaaggcaaagcctttgtggtgaaggtcagcgacggcggcgatatcagccagcttactgcggctgttccggcagcctcttccgcaccggttcaggctgccgctcccgcaggcgccggcaccccggtcaccgcgccgctggcgggcaacatctggaaggtgattgccaccgagggccagacggtggccgaaggcgatgtgctgctgattctggaagccatgaagatggaaaccgaaatccgcgccgcgcaggccgggacggtacgcggtatcgcggtgaagtccggcgatgcggtctccgtcggcgacaccctgatgacgctggcgtaaggacgaggagcggaaatggaaagtctgaacgccctgcttcagggcatggggctgatgcaccttggcgcaggccaggccatcatgctgctggtcagcctgctgctgctgtggctggcgattgcgaagaagttcgagccgttactgctgctgccgataggcttcggcgggctgctgtcgaacattccggaggccgggctggcgctgaccgcgctggaaagcctgctggcgcaccacgacgccggacagctggcggtgattgccgcgaagctccactgcgcgccggacgtgcatgccattaaggaagcattagcgctggcgctgccctccgtccagaaccagatggaaaatctggcggtggacatgggctacacgccgggggtgctggcgctgttctacaaagtggcgattggctccggtgtcgcgccgctggtcatcttcatgggcgtcggcgcgatgaccgacttcggcccgctgctggccaacccgcgcaccctgctgctcggcgcggcggcgcagttcggtatcttcgccaccgtgctgggggcgctgacgctgaactacttcggccttatcagcttcaccctgccgcaggcggcggccatcggcattatcggcggcgcggacggcccgacggcgatttatctgtcgggcaagctggcgccggagctgctgggggccatcgcggtggcggcgtactcgtatatggcgctggtgccgttaatccagccgccgattatgaaagcgctgaccacggagacggagcggaaaatccgcatggtgcagctgcgcacggtgagtaagcgggaaaaaatcctctttccggtggtgctgttactactggtggcgctgctgctgccggacgccgcgccgctgctggggatgttctgctttggcaatctgatgcgcgaaagcggcgtggtggagcgcctgagcgacacggtacagaacgggctgattaatatcgtcaccatcttcctcgggctgtcggtgggcgcgaagctggtggcggacaagttcctgcaaccgcagacgctgggcattctgctgctgggggtgattgcgtttggtatcgggacggcggccggggtactgatggcgaagctgctgaacctgtgcagtaagaacaaaatcaacccgcttattggttcggcgggggtgtcggcggtgccgatggcggcccgcgtatcgaacaaggtgggcctggagtcggacccgcagaactttctgctgatgcacgcgatgggcccgaacgtggccggggtgattggctcggcgatagccgccggggtgatgctgaagtacgtgctggcgatgtaaatctgttcctttcccggaggcggcgcgttgcgcctgtccgggctaccggattgcatggatctgtagcccggacagatgcgcagcatcgtctccgggaatgtcccataaggagactttgatgaatgaaaccatagcatttcgtccggaaggccgggcatcgataaaagatgtggttgtcaattatacgctggcatcactggacgagcttgaacaactgcacccggcgctgaatctgctggcgcacccgtcaattgtccgtggcagccatgatttctttgtccgttgttatgacgcgggcgtacagcatgcgcaggccggggcggctgaaacggtagcggttttgcctgattcgctgccacaagaacggcaaaggagcgggctgctgtgtgccgcagcaggtcgtctggatgccctgcgccagccgctgacgcacaatcgtttatgtgacctggccagtcagttctgtgctggcatggcagatgttgacagcgaaacccgcagcggtttttataccgtgcgcagcatatcgctgccggtttaccggcggctgttgcgggatcaacattctcacggtgtctgcctgcagcaggctctgctgcacctgctggcctggaagagcgattctccctgggcgcggcagcaggcgcagcggctgctctggcagggcggcgtgctgggcgataaaggtgagtttgcgcttatgacgctggatgatgaactgcgggagcgccagattgggtggcccgggctgtggtcgctgctggccgtcaccgggtttctggcgaaattccctgccggaccgatatttgctgactgaaaaatgaggactgctgacaattatctgttgtgttggcatttctgcgagaggcagctagcgctttgcctgacttacgaaacgagaatatcaacagattacgtactttttgtaggtccgtggttggaacattgccacctggttacacgttgtcagcagcctcaagcgtggatggctccacgctgtctttgtctatggaaaacccccagtcaggccctgtctcttgatcaggagatctgatcaagagacagggctatgccggaggatatttattggaaaccgatgagataggccaccgtgtcattaatcgaaatataaataaatatataacgaaataattcggcgctataattctcctctgattaataacgtagcccgaaccatgacctgtcaggacaaatcacttttagcccccgctctcgcttccacgcccgtcattccgcgctatcgccagatcatacgcaaacgggctgtgctcatgttagctattgcgttggcgatgatggcttcactgatggtggatgtaacctgtgggtcttctggtttaccgctcagtgcgctatggcaggcgctttttcaaccggaaaaagtgaatgcgggcatacacgttattgtctgggatattcgtttaccctatgccctgatggccctactggtgggcatggcgttagggttagcgggcgccgaaatgcaaaccattttaaataatccgctggcgacgccgtttaccctcggcgtatcgtccgcggcggcttttggcgctgcgctggcgattgtgttggggatcggtattcccggtattcctgccgcctggtttatcccggccaatgcgttcatctttgcgctgttatccgcgttactcctggacggtattacccgttggacaggcgtcgccgcatccggagtggtgttgtttggtattgcgctggtattcacctttaacgcgttggtcgccattatgcagtttgtggctgatgaagatacgctgcaggggctggtattctggacgatggggagcctggtccgcgcgtcgtgggaaaaattgggcgtactggccgtggtgtttattgctgtgcttttttgcgcgttacgaagcgcctggcaactcacggcattacgtctgggcgaagagagggcgatgagctttgggattcatgtccgccgtttacgcctgctgtcattgttgcgtatcagcttgttatcagcgctggcggtagctttcgtcgggccgattggttttattggtctcgttgcgccgcacattgcgcgaatacttttgggggaagatcaccgtttctaccttccgggcagcgtgctgataggcgggctggtgttatcgctggcctctattgcggcgaaaaatagtattccgggcgtcatggtgccggtggggattgtcacctcgctggtcggggttccgttctttttaagcattgtattgcgacatcgggggagtctctgatgcgcgggttaatgctccgctcatttagcgccggctattccactcagccggttattgcagatctcaacgttcccttactgccgcgcgggaaaattaccattttgctggggccgaacggctgtggtaaatcgacgttactacgttcgctggccgggctgaataacgccgacggcgaggcgctgcttgatggcgaagatctcatgtcgttatcgtttgccgagcgggcgcagaaagttgtgtttttgccgcagtcattaccgcagggcgtacatctgcatgtactggagtcgattatcgtggtactgcgggcatcaggcggcagagacaatgcgcagggcagagcgcagatactggctatccttgagcaattgggcataacgcatctggcgttgcagtatctcgaccagctttccggcggtcagcggcagttagtgggtctggcgcaatcgctgattcgtcgccctgaacttctgttgctggatgagccgctcagcgcgctggatttaaactatcagtttcacgtaatggatctcgtgcgtcgggatacccaggcgcaaaatagggtaacgatagtcgtggcgcatgacattaatattgcactgcgtcatggtgaccatgtcctgatgctaaaagacggcaggctggtcgccagcggcgcgccggagacggtgattactgcggagcgtctggctgaagtgtaccgggtacgaggacgcgtggagcgctgttcgcaggggaaattgcaggtggtgctggacggcgtgatcgctgtttaagacatattgcctgatggcgctgcgcttatccggcctacccattgctcgtaggccggataaggcagttataccgccatccggcaaaggtgattacttcgctttaccctgattcgccacggcagccgctttcgcggcgatttcgtcagcgttgcccagatagtaatgtttgagcggcttgaagttttcgtcgaactcatacaccagcggcacgccggtcgggatgtttaactcaaggatctcatcttcactcatgttatccaggtatttcaccagcgcacgcaatgagttaccgtgagcggcgatgatcacgcgctcaccgctcttcatacgcggcaggatggtgtcgttccagtaaggaataacgcggtcgatggtcagcgccagactttcggtcaacggcagctctttctcgctcagtttggcataacgtggatcgtgacccggataacgctcatcatctttggtcagttccggcggcgtcacggcaaaaccgcggcgccactgtttaacctgctcgtcaccatatttttctgccgtttccgctttattcagcccctgcaacgcgccatagtgacgttcattgagtttccaggatttttccaccggcagccacgcctgatccagttcatccagtacgttccacagcgtatggatagcgcgtttcagtacggaagtgtaggcaaaatcaaagctgaaaccttcttcttttagcagtttacccgctgcttttgcttcgcttacgcctttttcagacaggtcaacatcataccagccggtgaaacggttctctttgttccattgactttcaccgtgacgtaccagaaccagcttagttacagccatactctcactcctataaatcatatgtaatgataataattctcattatattgccgcgaggtgttggcggcaatgcttacgcataaccatagcgaaaatagtggcgcagtgtaaggttcttgtgaattcagagttgcgattttgtctttaagtggtggaggtttgagcagggcaatggcgcgtaggcccgataagcttgcgtcatcgggcatgtagcggcatatcgttagaacggaataaactgatactcggtcaggctggcgtactcctcgccagggcgaaggatacagtcaggctgcggccattcaggatgattcggactgtccggcagcagttcgctttccagcgccagcccttgccagtcggcataaggttccggcccgcgggaaggtgtacccgccagataattgccggaataaaactgtagcgccggggcggtggtgtaaaccatcatttgtagctttccatcctgtgaccacagacgggccgccggctttttgccatcaccctgcgtctgtagcaggaaagcatgatcgtagcctttaaccttgcgctgatcgtcatcggcgagaaattcactggcaatgacttttggcatccggaagtcaaacgaggtattggctaccgattttagcccctggcgtggaataccggattcatctaccggcagatactcatccgccagaatttgcagcttatgctggcgcacgtcggtccgatcgccgtccagattaaaatagacgtggttggtcaaattcaccggacagggtttatcgaccgttgcccggtaggtgatggagattctattgtcatcggtcagacgatattgcgccgtggcgcaaagatggccgggaaaaccctggtcgccgtcatcagaggtgagcgcgaataatacctggcgatcgttctggttcacaatttgccagcggcgcttgtcaaagccttccggtccgccgtgtagctggttctcgccctgacttgggcttaactgtacggtttcgccggcaaacgtatagcggctattggcgatacggttcgcgtaacggccaatagaggcgccgaggaatgacgtctgttcagggtagtgttccgggctggcgcagcccagcaatgcttcccgaacgctgccgtcagacagcggaatacgggcggaaagaagagtggctccccagtccatcagcgttaccaccatccctgcgctgttgcgcagggttagcaggcggtacggttgaccatcgggggccagtgcgggcgtttcatttagcactgtcctgctccttgtgacggtttgcatacataaaaggtttctttgattccggttttcgcttcgtactgttgcgcaacggcctgccgaacagcgggaaccagatcttccgggatcagtgcgacaacacacccgccaaagccgccgccggtcatgcgcacgccgcctcgatcgccgatggtcgctttgacgatgtctaccagcgtgtctatctgcgggacggtaatttcgaaatcatcgcgcattgaggcatgggactccgccatcagttggcccatacgttgcaaatcacctttctccagcgcgcttgccgcttcaacggtgcgcgcattttcgctcaatacatggcgaacgcgttttgcgactaccgggtccagttcgctggcaacggcattgaacgcctcaaggctgacatcgcgcagggccggctgctggaagaaacgggcgccggtttcgcactgttcacggcgggtattatactcgctgcccaccagcgtgcgcttaaagttactgttgatgatcaccacggcgacacctttcggcatggaaaccgctttggcgccgagcgtacggcaatcaatcagcagcgcatgatcttttttgccgagcgcagagatgagctgatccataatgccgcagttacagccgacaaactggttctcggcctcttgtccgttgagcgcaatttgcgcgccgtccagcggcaggtgataaagctgctggaagacggtgcccaccgccacttccagcgaggcggaggagcttaacccggcgccctgcggcacattgccgctgatgaccatatccacgccgccaaacgcgttgttacgctgctgcaggtgtttcactacgccgcgcacatagttagaccactgctggctatcgtgggtcacgatcggcgcatccagtgaaaattcgtccacctgattgtcgtaatcggcggcaatcacccgtacggtacgatcgtcgcgcggcgcacagctaattacggtctggtaatcgatagcgcagggcagaacaaaaccatcattgtaatcagtgtgctcgccgatcagattgacgcggcctggcgcctgaatcgtgtgggtagcagggtagccgaaaatttcagcaaacagcgcgcgcgttttctctttcagattcatttttatactccggattcgcgaaaatggatgtcgctgaccgcgcgcaggcgttcagccgcttgttctgcggttaaatcacgctgggtttccgccagcatttcatagccgaccataaatttacggacggtcgcagagcgcagcagcggcgggtaaaagtgtgcgtgcaactgccagtgtgcgttttcttcaccgttaaacggcgcgccgtgccagcccattgagtaggggaaggaacactgaaacaggttgtcataacgactggtcagctttttcaacgccagcgccagagagtcgcgctgctcgtcgcttaaatcggtaatgcgcaggacatgcgttttgggtaacagtagcgtttcgaacggccacgccgcccagtaaggcaccaccgccagccagtgttcggtttcgaccacggtgcggctgccgtccgccagttctcgctggacataatccaccagcattggcgagcgctgctcggcgaagtaggctttttgtaaacgatcttcgcgttcggcctcattcggcaggaagctgttggcccagacctgtccatgcggatgcgggttcgaacagcccatcgccgcgcctttattttcaaagacctgcacccacggataggttttgcctaactcggcggtctgcgtctgccaggttctgacgatttccgtcagcgcgggcaggctcaactccggcagcgttttactgtgatcgggagaaaagcagatcacgcggctggtgccgcgcgcgctctgacagcgcatcagcggatcgtggctgtccggcgcatccggcgtgtcggccatcagcgccgcgaaatcgttagtaaagacgtaagtccctttgtaatcgggatttttatcgccggtgacacgcgtattgcccgcacacaagaagcagtccggatcgtgggccggcagcatttgctgagacggcgtttcctgcgccccctgccaggggcgttttgcgcgatgcggcgaaaccagaacccactggccggtaagcgggttataacggcgatgcggatgatcgatgggattaaatggggtcataacaacgtccttaatctgggtatccctgcggatggcgtgactgccagtgccaggtgtcctgcgccatttcgtcaagcgtgcgggtgacgcgccagttcagctcgcgatcggctttgctggcatccgcccaatacgccgggagatcgccgtcgcggcgcggcgcgaagtggtaattaatgggtttaccgcaggctttactaaaggcgttgaccacatccaggacgctactgccgacacccgcgccgaggttataaatatgtacgccggatttgtccgccagtttttccattgccacgacgtgcccgtcggctaagtccataacgtgaatgtaatcgcgtacgccggtgccatcctcggtcgggtaatcattgccgaaaacggcgagcgattcgcgacgacccacggcgacctgggcgatatagggcatcaggttattcggaataccttgcggatcttctcccatgtcgcccgacgggtgcgcgccgaccgggttgaaataacgcagcagcgcaatactccactccggctgggctttttgcagatcggtgaggatctgttctaccatcaatttacttttgccgtaggggctttgcggcgtgccggtaggaaaactttcgacgtaagggatcttgggctgatcgccataaacggtggcagaggagctaaaaataaggtttttaacgttggccgcacgcatggcgctgaccaaccgtagcgtaccgttgacgttgttgtcatagtactccagcggcctggcgaccgattcgccgacggctttcaggccggcaaagtgaatcacggtatcaatcgcgtgatcgtgcagaatttcggttataagcgcttcgttgcgaatatcgccttcgacaaaggtcgggtgcttaccgcccagacgttcaatcacgggcagcacgctgcgcttgctgttgcagaggttatcgaggatgacgacgtcatgaccattttgcagcaactgtacgcaggtatgacttccaatgtaaccgctaccacctgtaaccaatactctcataattcgctccgttaagcctatggtatggaataaccatagcataacaaagatgcgaaaagtgtgacatgtaataaattagtggaatcgtttacacactggtgattttacgcatttgtatcgattaaatgattacaaatcatctggcttgagaatgcttctgctttttatccgaaaaaaaggcgcgttacgcgcctgggaatgaaacggacggggcaagagctgtcagtcttttttacgcgagagtagcttcctggcgagcgccccgacagcgacgacgccgatggcggtcactttccagaatttaagcaacgcgataccgagcatagcaagcagtcctactttcttggccgcgataccgccaatcagcgcggcgagcccatactccgctattttgtccgttgattcgttgaagtcagcgtagcgttgtccagcgttgaacttgacggaactgagaattcttttcgccagagggatttcgtggtcaacagaacctctgtcggtcaccagatttaaagaaaaatagccttcacgtcccagcagataggtgttgtagttcacgccttgttcattcagtggttcgttggtgccgatatcctggatggcggcggaccagatcagacgatgattggttgcatcgtaggtaggcttctcgatccagccaataatttctatcggctcaatgccttttgcaatacgatctttattcgcttcttttgtgcctttgcgcaggttatccattaattcatcggcatcccagttttttgcatcatcatcttttacataaccagaatcatcatattcgatagaaataaatccattcatttcctttttaaatacgaggccgtaaaaatattcatcgtcaacatagttaccaatttcacgcataaataccgccgcttcttttgcgggtatccaggtaaatccttccggcagattaagcgtggctttatcacctaaactaatctttgtcggacccgcaacggcggcgcgactcatgtcttcaacagcgacctcaacagcggttttacgcgcttcctgcgcagcggtcggcttttgctcagcataactgctggggcaaaataaaatagctgccagtaaaaatagtattatttgtggaaaacgaaaagccataatgaatcccttatattcacatacgacatcattgtcgaaaatttcaggattattatgacaatgaggcggtcagcgattcaagagatagtaagcttatcgaccgttattattattcttaataaaaggagagtggttccagaatggcgcgcggcgccattctgataatacatttaattattgcatcgtccggaaacgtacttataacgttcgccctctggtacaaattccagccggtgggtaatacaggcaggcgcatcctctgcatgatgggaaacgaacagcagttgggtctctccctggcgaattaatacatctacaaaacggcgtaccagttggcggttcagcgggtccaacccttgcagcggctcatccagaatcaacactgtcggatgcttaaccagcgcgcgcacgattagcgccagccgctgctgtccccaggagagactgtggaagggggcatccgccgtacgcttatcgattcccagaatatccagccactgttgcgccagttttcgttgcctgtctgaaacggcctggtaaatgccgatagaatcgaaatagccggagagaatgacattgcgtaccgtggtactgacgcggtaatccagatgtaaactgctgctgacgtagccgatatgttttttgatatcccagattgtttcgccgcttcctcgccgccgcccgaacagcgtaagatcgttgctgtagccttgcggatgatcgccagtaataaggctaagcaacgtagacttacccgctccgttaggaccgacgatctgccagtgttcgcccggattgactcgccagcttaagtggtggaggatagggcgatcgttatacgagactactccatcgttaagtacgatccgtggttcgccatcgggtaacgcatggcgggcggaaggttcgtccggttcgggtaattgtacgtcggtcagacgctcgctgtgcgcgagttgagcaaccaacgcccgttgcagcaactccgccgtcgttccggtctccgccagcgtacagtcggcaagcacgccggcaaactgcacgaagtccgggatctcatcaaaacggttgagtaccagcgccagggtcatacccgcctggttcaacgccgtcaggcgttgcgccagttgttgacgggcggtcacgtcaagcccgtcgaacggttcatcaaggatcaataactctggctcagacatcagcgcctgacacagcagcgcttttcgcgtctcgccggtagaaaggtatttaaaacgcctgtcgagtaaagcggaaatgccgaactgctgcgccagtatcgcacagcgggcaggatggtgaacatcatcctgaataatttccgcggtagtgcgcccggtatcgtcttcgccaggactgagcatatcggtgttattacgttgccactcatcgctgaccagcttttgcaattgttcaaaggacagacgagtaatgcgggtaaaccgacactggcgctcgcctgttaataacggcagttcgcccgccagcgcgcgggcgagcgccgacttcccgctcccgttagccccaacgaatgcccagctatcgcccgcattgagcgtcagcgaatccagatgaagtgtttttgtatcgctcagacgaaacgtgccttgcgaaatttgcaacgatgacattttgcatcccattttttgcagcgatgaatgacagggatacgtctttcggcaacggatgtcaatgtgcttagcacaacgttgcaataatcactctgtccgcattaaaccaggcaatcacgtcatcgccttcctttaacgtggcggcatctgaagtcggtatcgtggcgcacagcgtctggccgtccggcagcgccatcaacacttcacactgttccgcgccgcgctcgatatggctgatcgttcccgacaactgattgtcagcggcgcgcgcaacggctgcatcccgggtaatgccaacccacggcgcttttagcaggatcagcacttcttttccctcctccaggccgagacgctcgccgctttgcgccgtcagcgcgactttgagccgcgttttgccgtcggccagcagcacgtcgacatgctgttgcaccagatcgcgatcgcgggcggtaatggtgccgaaccactgatttcgggcgctggtttgcagtgaaaagcgggagatagcggccagcagactgtcaagcggcagggcgtcatcgtcgcttaacacatcgaacgctttttgctgaatttggcccagcaaatcgtaaagctggatcagacgctggccatagcgggttaataccgcgccgccgccgcctttgccgcccgttgcgcgttcaaccagcatatgttcgctaagctggttcatgtcgtttatcgcatcccaggcgctcttatagctgattcccgcgtctttcgcgccctgactaatcgagccggaaagcgcaatgtgtttcagcagagagatacgtcggggatcggcaaaaagcttttgctgaagtttcagggtaagaaggatttcggcctgcataaccagctcctggtaaaaagactattgtgactgaaaagcgcgtcagcgcaaagccgaccgcacaaaaggggagtgcttttctgtgtgatgcggttaaaatacaaaaaggactatatctggagttgcccatgttagagttattaaaaagtctggtattcgccgtcatcatggtaccggtagtgatggccatcatcctcggtctgatttacggtctgggtgaggtgttcaacattttttccggtatcggtcagaaagaccagtccagacagaaccgctgatttccccaaacgcccgctcagtcgggcgtttttgttactcaagatcctgcttttcctgccgatattttctgtgtttaatcgttaatgggtatgaataaccgctgggaaacccctgagattatcgttatattatcgtttacataacgaaacgcacaaggagttacagatggcgcattcctggttacgcctggtcgcaggggcaacattatctttcgtcatcgccggtcatgcgctggcggatgaaggcaagatcaccgtatttgccgccgcgtcgctaacgaacgcgatgcaagacattgcggcagaatataaaaaagagaaaaatgtggatgtggtctcctcattcgcctcctcttcaacgctggcgcgccagatagaagcgggcgcgccggcggatctcttcatctctgctgatcagaaatggatggattacgcagccgataaaaaagcggtggataccacgacgcgcgaaacattgcttggcaatagcctggtggtggtagcgccgaaagccagcgagcagaaaccgtttaccatcgacaacaaaacggactggattcgtctgctgaacggcggacgtctggcggtgggcgatccgcaacacgtaccggcgggaatttatgccaaagaagcgctgcaaaagttgggcgcatggcaaacgcttgaaccgaaactggcgccgggcgaggatgtgcgcggcgcgttggcgctggtcgaacgtaacgaagcgcctttgggcattgtatacggttctgatgcggtcgccagcaagggggtcaacgtggtggcgacgttcccggaagattcacataaaaaagtggaataccccatcgctatcgtggaggggcataaaaatgcgaccgtcagcgcgttctatgattacctgaaaggaccgcaggcctcggcaatctttaaacgttatggatttacgacgaagtaatgatactgaccgatccagaatggcaggctgtccttcttagcctgaaagtgtcttccctggccgtgctgtttagcctgccgtttgggatcttttttgcctggttactggtgcgatgccggtttccgggcaaagccttacttgatagcgtcctgcatctgccgctggtgctgccgccggtggtggtcggctatctgctgctggtgtcgatggggcgacgcggatttattggccagtggctgtatgactggttcggtctcacgtttgcctttagctggcgcggcgccgtgctggcggcggcggtgatgtccttcccgctgatggtgcgggccattcggctggcgctggagggggtggatatcaagctcgaacaggccgccagaacgctgggcgccgggcgctggcgcgtttttctgactatcaccttaccgcttaccctgccaggcattattgtcggtacggtgctggcgtttgcccgttcgcttggcgaatttggcgcgaccattacctttgtttccaatattccgggcgaaacccgcaccataccttccgccatgtataccttgatccagacgccgggcggggagagcgcggcggcgaggctgtgcgtgatttcgattgtattagcgctgatttcgctgttgatttctgaatggctggcgcggattagccgtgaacggacggggcgctaaccatgctggagcttaatttttcccagacgctgggaacgcactgtttaaccctcaacgaaacgctgccagccagtgggatcacggctatctttggcgtctccggcgcgggaaaaacctcgctgattaatgccatcagcggtttgactcgcccgcaaaaaggacgcatcgcgctgaatggccgggtgttgcatgacgcggaaaacggtatctgtttaacgccggaaaagcgccgcatcggttatgttttccaggatgcgcgcctgttcccccattacaaagtacgcggcaatttgcgctacggcatggcgaaaagcatgaccggtcagtttgataagctggtgtcgctgctgggaattgaagcgttgcttgatcgcctgccggggagcttgtccggcggagaaaaacagcgcgtagcgataggccgggcattgctcaccgccccggagttgctgctgttggacgaaccgttggcctcgctggatatcccgcgtaaacgcgaattactgccgtacctgcaacggctggcgcgggaaatcaatattcccatgctgtatgtcagccattctctcgatgaaattctccacctggcggataaagtcatggtgctggaggatggacaggttaaagcgtttggcccgctggaagaagtctggggaagcagcgttatgcacccgtggctgccgaaagagcaacagagcagtattctgaaagtcagcgtgctggagcatcacccgcattatgccatgaccgccctggcgcttggcgaccagcacctgtgggtaaataaactcaatcagccgctgcaatccacactgcgtattcgtatacaggcgtcggatgtctcgctggtactacagccgccgcagcagaccagtatccgcaacgtattgcgggcaaaagtggcgaattgttatgacgataacgggcaggtggaagtccagcttgagataggcggcagaacgctgtgggcgcgaataagcccgtgggccagggatgagctgaatatcaagcctggcctgtggctttacgcgcaggtgaaaagcgtttctatcaccgcctgactatagcaggtgggtgtaaataaatttggcgatgctatcggtagtgttatcgccgatcacaacgtcagcgcgcgctttcaccgcctcatcggcgttgcccatcgcaacgccggtgcctgccgcctccagcatactgatgtcgttgtagttatcgccgaaagcgatcacatttttcattgaccctccctgcgcttctatccactgggtaaggcgcttgcctttactgttgcctttgcgcgcgatatccacctgatcgtgccatgaccattcgcactccaggccaagcgcctgttcaacatgctgaccgaaccgctgtagtctgggaatatcttcatcggtaagcgcaaacttccacacggcattcacgtcgcgcgccgcctgcgctaacgaagagacctgtgtaaaggtcggacgttgttccggcggcaaggtctgcgcccaccgggaggtacgcacgacgtggccggttgggtgttcgtaaagcatagcgtcatcaacatacatcaggccgtgaatctgatgctcatccagtaaatcaatcaactgcaacgccttatccacgggcataggatcggcatccaggacagttttagcttgataatcatacaaataggtgccgttgcagcaaatagcaggtgtttccagcgccagcgcctgataaaaaggatgaatagcaacgtgatggcgaccagtgacaatgataagttgaaagcccgcctctttggcgcgtgatagcgcttcaagcgaggaggggagtaaggttttatgcggggttaataatgttccgtctaaatcgagggcaatcacgcgtgcagtcataattttttccagattaagagtaataactccgtctgtcggcatggtacaccgggacggtaagcagacaaaattctgcgtctgaattcagcattcgccgtcaaaagcgactacgttaagctgtgtcctgttattgcagctacatgccatatgcaaaggagtattcatgaaacaaacagtctataccgccagccctgagagtcagcaaattcacgtctggagcctgaaccacgaagggacgctgacgctggtgcaggtcgtggatgtgcccggtcaggttcagccgatggtggtcagtccggataaacgctacctctatgtcggcgtgcgcccggagtttcgtgtcctggcgtatcgtattgcgccggatgatggcgcgctgacgtttgccgccgaatccgccctgccgggtagcccgacccatatttctaccgatcatcatggtcgttttgtctttgtcggatcgtataacgccggtaatgtcagcgtgacgcgcttacaggatggcctgccggttgagctggtggatgtggtggaggggctggacggctgccactcggcaaatattacgccggataaccgtaccctgtgggtgcctgcgctaaaacaggatcgcatttgtctgtttacgctaagcgatgacggccatctggtggcccaggagccggcggaagtaaatacagttgaaggggcaggcccgcgtcatatggtcttccacccgaatcgacaatatgcgtattgcgtcaatgaactgaacagttcggtggatgtctggcagcttaaaaatccgcatggcgagatagagtgcgtgcaaacgctggatatgatgcccgccgatttttccgatacccgctgggcggcggatattcatattacgccggatggacggcatctgtatgcctgtgaccgcaccgccagtctgattaccgtctttagtgtctccgaagatggcagcgtactgagcgttgaaggcttccagccgacggaagcccaaccgcgcggctttaatatcgacaatagcggaaaatacctgattgctgcgggtcaaaaatcacatcatatcgcggtctatgaaattacgggcactcaggggttgctgacggaaaaaggccgttatgccgtcggccaggggccaatgtgggttgtggtgaacgcgtactaaagcgctgtgtgccggatggaggcgggctggagctcatcaaggcgggatgcctgattaatttcaataaacattgcttgcagtaaaaccacgggccgccacatctgctgcggcggcccgtttataagcctgaaccggaacggtgattactgcttaggttccgccactactttactgcctataccgcggttgttgtattcccacatgcggttgtagttagtgtcgttcagattacgctgcacctcgtctttgtcatccacggttcccgtatttccagcaaacggacgtttcgagatgaccgcgtcggcccacggtttggcaacgttgaagccctcgttaatcacgctgtcgcggatcacgacctgaccgttggtgttggcgtcgacatccagcgagcggccaagctgcgcaacgccatcgccggaggcgttaaagcggctgttgatcgccaaaaagccatagtaaatattggacagcgtcgccggggcgaagacgtaggcttcctgctgtgtgcgggagttgacgacctggaagttggtgttatcgaacaccacggcgccgcgtccggaaaccatatccacatcgccttcaatatagctgttcgtcaccagcgtacgtggctggcgatcggtttgcagacggttctgcacgccgctgttggtcacaaagaaggtgttctggcggccaaggatattgaccttgttaatctggactttgtcgccatcggtacgcagcgccaccgccggatggtttccggcatcgacgctgtcgcccagcgtgttctcgatggtcagattttgtagctgcagaccgttattctgcgaccagaacgcggcagaacacattacaccgatcgtcgcggcgtgtttgctttggcagttatcgaacatataccaggcgggtttaccaggcatatatttcccgccgggattcaccgcgcggcgccagtcagcgacactcatttcaccatcaatcgccatcccaattttcacatcgatcggtttttcaccggtcccgtacagggtcagacttcccggcgcggcgggaacatacacggtcccctgatagtcgcccggcataatagcaatgtactggcgtttgttcgtgcgtttaaccattgccgcatcgaccgcggcctgaatcgaggtgtgcgtaacgcctggcgtacctgccggccccaccacaaagtcaggctgtgcgggcagggtaatcggcgacggcgaccacggggcggtattcggcgtcagggaggcaaaatagcgcgccgcaacgaagtttttcgcttcatttgccgacagaattgggcgcgaggcggtgccaggcgcggtttgatcggaagggatctgatcgggtggcgtagagctacaggcgctcagcgtcacgccaaaagccagtgccagcgccagacgggaaaccgataatgtattcacaggttgctccgggcttgaaaaagttaaatgacatccattgaagcctgcttttttatactaagttgaacgaaacgggaaggcgaaaaggtaaaaagttccttttcaggccggaaacacctgtagcatcagatagttttatcacaattaagcaacaactttcgcgctttgagttgacaatccggagcagaaagaaaataaatgtctatacaacccatgacaggcaagagagcgacaggaatgcggcaacttttaccgggcgatactgtctggcgaaacatcaggctggcgacaatggacccgcagcagcaagccctgtacgggctggtggataatcaggcgctgattgtgcgcgaagggcatatttgcgatatcgtgccagagacgcagcttcctgtcagcggggacaatatccatgatatgcagggacgactggtaaccccgggacttatcgattgccacacgcatctggtgtttgccggtaaccgcgccgcagagtgggaacagcggcttaacggcgcgtcataccagcatattagcgctcagggcggcggcattaacgcgacggtatcagcaacccgcgcctgtgcggaggagacgctctacctgctggcgcgcgaacgcatgatgcgccttgccagcgaaggcgttacgctgctggagattaaatccggctatggtctggagctggcgacagaagaaaagctgttgcgcgtcgctgcaaaacttgccgccgaaaacgctatcgacattagccccacgctattggccgctcatgctacgccagcggagtatcgtgacgacccggacggctacatcactctggtctgcgagacgatgattccgcagctctggcaaaaagggttatttgatgcggtagacctcttttgcgagagcgtcggctttaatgtggcgcagagtgagcgcgtattgcagacggcgaaggcgttaggtattcccgttaaaggccatgttgagcagctttcgctgttgggcggcgcgcagttggtgagccgttatcagggcttatcggcggatcatatcgaatatcttgatgaagtgggcgtcgcggcgatgcgtgacggcggtactgtcggcgtattattgcccggcgcgttttattttctgcgcgagacgcagcgcccgccggtagaactgctgcgccgctatcaggtgcctgtcgccgtcgccagcgatttcaatcccggcaccagcccgttttgcagtttgcatctggcgatgaatatggcctgcgtacagtttggtctgacgccggaagaggcatgggcgggcgttacgcgccatgccgctcgcgcgctgggaagacaggcgacgcatgggcagatcagggccggctaccgggcggattttgtggtgtgggatgctgaacagccggtagagatagtgtatgagccggggcgtaaccctttatatcagcgggtatacagaggaaaaatctcatgacgcaatggtatccggcttctccggcgctctggcaggggcgcgatgacagtatagaagcgccggatgcgcggcgtctgtttcagaccgtcacgcgcagcgagaccttttcccccgaaaactggcagcaaaagatcgcgttaatgggatttgcctgcgacgagggggtaaaacgcaatgcagggcgtcccggcgcggcaggcgccccggacgcgttgcgtaaagcgctggcgaatatggccagccaccagggacatgaacggctggtggatttaggcaattgggttgcgccgacgcccgatctggaaggcgcgcagcaggccttgcgcgatgcggtaagccgctgtctgcgggccgggatgcgcacgctggtactgggcggcgggcatgaaaccgcgtttggacacggcgcgggggtgctggacgcgtttgcgcaggaaagcgtagggatcattaatcttgatgcgcatctggatctccgtcagaccgaccgggcaacatccgggacgccgtttcgtcaactggcgcagctatgcgacgcgcagagccgcgcgtttcattatgcctgtttcggcgtgagccgtgcggcgaatacgcaggcgttgtggcgggaagcgcagtggcggaatgttaccgtggtggaggatctggactgccatgacgcgctggcgcagatggcgcagtttatcgacaaggtggataaaatttatctgactatcgatctcgacgtattgcctgtctgggaaatgccggccgtctccgctcccgcagcgctgggcgtgccgctgatacaggttctgcgtttaattgagccggtttgccgcagcggaaaattacaggcggcggatctggttgagtttaatccacgctttgatgaagatggcgcagcggcgcgcgtggcggcgcggcttggctggcaaatcgcgcactggtggcgttaatctgtcatccggaaaacattatccgcataaggaaggcttcacgcatgtattcatcccgctcccgttctgcacctgcgcctttttacgaaacggtgaaacaggacatctgtaaaaaaatagccggcggcgtctggcagccgcacgatcgcattccgtcggaagcagaactggtcgcccagtatggctttagccgaatgaccatcaatcgggcgctgcgtgagctgacggatgaagggtggctggtgcgtttacagggcgtggggacgtttgtcgccgaaccgaaaggccagtccgcgctgtttgaagtccgcagtatcgccgaggagattgccgcccgccgtcatcagcatcgttgtgaggtgctcacgctggagcgcgtgcgggcaaacgccatccaggccagcgctctcaacgtcaatgagagcgatgtcattttccattccatcatggtgcattatgaaaacgatctgccggtacaaattgaagatcgctgcgtgaatgcggatattgccgtggattacctgacgcaggattacagtcagaccacgccgcacgcttatttgtcgcggatcgcgccgctaacggaaggggaacatattgtggaggcggtgcgcgccacggcgcaagagtgcgcgtggttaactatcaaagagcatgagccttgtctgctcattcgtcgtacaacctggtccgcgtcgcggattgtttctcacgcccgcttacttttccccgggtcgcgctaccggctacagggacgatttatctcctgagcggactgctgccggaaaacgtgattgctgacacaatataacaaaattgtatcatttttgttaattctattcttgtgcttacttgtatagacaagtatatgtctgattcttatctgtgggtctgcggcggtgcctgatagtggcgttttagcgttatttggcgatggcagaccgataataatgaggagtcattgctatgcctgaaagcaagtatcgtcagcagactatccgcgcgcccagaggcacggtattaacggcgaaaagctggctgacagaagccccgctgcggatgttaatgaataatctcgatcctgacgtggcggaaaatccgcatgagctggtggtctacggcgggattggtcgcgccgcgcgcaactgggaatgctatgacgctattgttgatgcgctcacccggctggaggcggacgaaacgttgcttattcagtctggcaaaccggtcggcgtatttaaaacgcacgacaacgcgccgcgggtattaatcgccaactccaacctggttccccactgggcgacatgggaacattttaacgaactggatgcgaaagggctggcgatgtacggtcagatgacggccggaagctggatctatatcggcagtcagggaatcgtgcagggaacatacgaaacctttgtcgaggcggggcgtcagcactataacggcacgctggcgggacgctgggtgctgactgctgggctgggcggcatgggcggcgcgcaaccgctagccgcgacgctggccggagcgtgttcgctgacgattgaatgccagcaaagccgtatcgattttcgtctgcgtactcgttacgtggatgagcaggccgccacgctggatgacgcgctggcccgcattacgcgctacacccgcgaggggaaagccgtgtccgtcgccctgtgcgcgaacgcggcggatatcctgccggaactggttaatcgcggcgtgcgcccggacctggtgaccgatcagaccaggcccacgatccgctacatggctatttaccctccggctggcgctgggaggagtatcagaaaaacgcgcaatccgatccccacgggacgatgcaggcagcgaaacgttccatggcggcgcatgttcgggcgatgctggcgttcagtaaaatgggcgtgccgacctttgactatggcaacaatattcgtcagatggcgaaagagatgggggtggaaaacgcctttgattttccgggatttgtgccagcctatattcgtccgctgttctgccgtggcatcgggccgtttcgctgggtggcgctgtccggcgatccgcaggatatctataaaaccgatgccaaagtcaaagagatagtggctgaggataaacatctgcatcactggctggatatggcgcgcgagcgcattcattttcaggggttaccggcgcgtatctgctgggtaggcctggagtggcggcaaaaactggggctggcgttcaacgaaatggtgcgttgcggcgaggtatccgcgcccattgtgattggccgcgatcacctggattccggctctgtcgccagccctaaccgtgaaaccgaagcgatgcgcgacggttccgacgcggtttccgactggccgctgttaaatgcgttgctgaataccgccagcggggcgacatgggtatcgctccatcatggcggcggggtgggaatggggttttcgcaacacgccggtatggtgattgtctgtgatggcactgacgaggccgccgcgcgtattcgccgcgtgttacacaacgatccggcgacgggcgtcatgcgccatgccgatgccggatatgatctcgcggtggaatgcgctgttgagcaaggtctgaatttaccgatggttgcggcgacgcaggggaaaggctgatatgaacaccatgacactcactccggggcagttaagtctctctcaactgtacgatatctggcgtcatccggtacagcttcggctggacgccagcgccattgacggcattaacgccagcgtcgcgtgcgtcaatgatatcgttgccgaagggcgtaccgcctacggcatcaacaccggtttcggcctgctggcgcagacgcgcatcgctgatgaagacttgcaaaatctacagcgatcgttggtgctgtctcacgccgcgggcgtaggcgacccactggatgacgcgatggtgcgtctgatcatggtattgaaaatcaatagcctggcgcgcgggttttccgggattcggttgagcgtgatagaggcgctcatcgctctggtgaatgccggcgtgtatccgctgattccggcaaaaggctcggttggcgcgtcgggcgacttagcgccgctggcgcatctgtcgctgacgctgcttggcgaaggaaaagcgcgctggcagggcgaatggcttccggcgcagacggcgctaaaaaaggccggactggagcctgtcgcgctggcggccaaagaggggctggcgctgcttaatggcacccaggcatcaacggccttcgcgctgcgcggtttgtttgaggcacaggagttatttgcctccgccgttgtctgcggcgcgctgactaccgaagccgtactgggatcgcgccgtccttttgatgcgcgcattcatgccgcgcgcggacaacaggggcaaattgacgtcgcgcggttgttccggcacctgctgaccgataccagcgccattgctgaatcacatcaccactgtcataaagttcaggacccgtattcccttcgctgccagccgcaggtaatgggcgcttgtctgacccagttacgtcagacgaaagaggtactgctggctgaggccaacgcggtatccgataatccgctggtctttgccgatgcgggggaggtgatctccggcggtaacttccatgctgaaccggttgccatggcggcggataatctggcgctggcgatagcggaaatcggcgcgctatcggagcggcgcatcgcgctgatgatggataaacatatgtcgcagttaccgccgttcttggtgaaaaatggcggcgttaattccggttttatgattgcccaggtcaccgccgcggcgctcgccagcgagaataaagcgctggcgcacccgcacagcgtggatagcctgccgacctcggcgaatcaggaagatcatgtctcaatggccccggcggcagggcggcgactctgggaaatggcggcgaatacccgcggcatcattgccgtggagtggctggctgcctgtcaggggatagatttacgggaagggttaacctccagcccgttactggaacaggcgcggcagacactgcgcgagcaggtggcgcactatacgcaggatcgttttttcgcgcccgatattgagtgtgcgacggcgctgctggcgcaaggcgcgttacagcgtctggtgccggactttatgtgaatgctgccggatggagcggcgcttattcggcttacccaacccgttggcagggtaagacgtttacgccgccatccggcacagcgtttaactgaacatcgccgtgatcgaggcgctggcgagcgaatggaaatgcacgttaaagccgaccatcgcgccgctggcgtcttcatcaacgtcaagacgctcgacgtccagcgcgtgaaccgtaaagatatagcggtgcgtttcccctttaggcggcgccgcgccgccgtagcccgctttaccgaaatcggtacgcgtctgaatgacgccgtctggtacggccaccaggcctgagccgaacccctgggtcagtacgcgcgtatccgccgggaggttcaccaccacccagtgccaccagccggagccggtcggcgcgtcgggatcgtaacaggtcacgacaaaacttttggtgcccatcggcacgttgtcccaggccagatgcggcgaaatattatcgccatcatagcccataccgttaaaaacgtggcgatgaggaagtttatctccatcgcgcaaatcgttgctgataagtttcatgcgctctccttttgactcaccagaagtgtagccagaagcagcatcgcttaccgctgattaatggctaaaaaatgtttcattgtgtaccgcgtcattgaccgcctgggtcaaacggcgcagttgatccggacgaataatgtagggcggcatcaggtagattagcttgccgaacggcctgatccagacgccttgcccgacgaagaagcgttgaagcgccgccatattgaccggatgcgtggtttcaaccaccccaatcgcgcccaatacccgcacatccgccacccagggcgaactttgcgcgggggctaactcagcgcgtaactgagactcgatagacgccacctgctgacgccattcgccgctttccagcagcgtcaggttggcgcaggcgacggcgcaggccagcggattccccataaacgtcgggccatgcataaaacaccccgcctcgccgttgctaatagtctctgcaacctggcgtgtcgtgagcgttgccgagagggtcatggtgccgccggttaaggctttgccgagacacagaatatccggcgcgatcccggcgtgctcgcaggcgaacagtttgccggtacggccaaacccggtggctatttcatcggcaatcagcagaatgccttcgcgatcgcacatgttacgaatacgcctgagccattgtggatgatatatgcgcatcccgcccgcgccctgaacgataggttccagaatcacggcggctatttcatggcgatgcgcggccatcaggcgggcaaatggcgcgatgtcgctttcatcccattcgccatccatccggctttgcggcgccggcgcgaacagattttccggcagatagcctttccacaagctgtgcatggagttatccggatcgcacaccgacatcgcgccgaacgtgtcgccatgataaccgtggcgaaacgtcagaaaacgctgacgcgattcgccgcgcgcctgccagtattgcagcgccatcttcatggccacttccaccgacaccgacccggagtcggccagaaagacacactccagcggctcaggcgttatcgcgaccagcttacggcacagattcaccgcaggttgatgggttatgccgccgaacatgacatgcgacatggcgtcaatttgcgctttcatcgccgcgttcaattgcgggtggttataaccatgaatggccgcccaccaggaggacatcccctcaatcaggcgtttgcccgaggcgagaaccagctcgcagccttcggcccgctcaacgggatataccggcagcggcgaggtcatggaagtgtaaggatgccaaatatggcgtttatcgaaggccagatcgtccgttgtcataatcgacttgtaaaccaaattaaaaagatttaggtttacgagtctacaccatatcaaaaacaaacaacatattttggagaagcccgatggctcgccacccacgctggacactgtcgcaagtaaccgaattatttgaaaaaccactgctggaattgctgtttgaagcgcagcaaattcatcgccagcatttcgatccgcagcaggtacaggttagtacgctgttgtcgatcaaaaccggcgcctgcccggaggattgtaaatactgcccgcagagctcgcgctataaaaccgggctggaagccgagcgtttaatggaagtagagcaggtactggactccgcccgtaaagcgaaaaacgctggttcgacccgcttctgtatgggggcggcctggaggaatccgcatgaacgcgatatgccttatctggagaagattgtacagggcgtcaaagcgatggggctggaaacctgtatgacgctcggcatgttgaacgagagccaggcgcagcgtctggctaacgccgggctggattactacaaccacaacctcgatacctcgccggagttttacggcaatatcatcactacccgtacctatcaggagcgcctcgacacgctggaaaaagtccgtgaagcagggattaaagtgtgctccggcggcattgtgggtctgggcgaaacggttaccgatcgcgccggactgttgttgcagttggcgaacctgccgacaccgccggaaagcgtgccaatcaacatgctggtgaaggtaaaaggcacgccgcttgcggataacgatgacgtggatgcgtttgattttattcgtactatcgccgtggcgcgcatcatgatgccgacctcatacgtgcgtctttccgcagggcgtgaacagatgaacgagcagacccaggcgatgtgctttatggccggggcgaactcgattttctatggctgcaaattgttaactacgccaaatccggcagaggacaaggatctgcagttattccgtaagctggggctgaatccgcagcagaccagggtgctggcgggcgataacgagcagcagcaacgtctggagcagacgctgatgacgcctgacaccgatgattattacaacgcggcagccttatgagttggcaacaacgcgtcgacgatgcgctgacggcgcgtcgggtgacggatacgttgcgccgccgctatgtggtatcgcagggtgccggacgctggctggtagcgaacgggcgacagtatcttaacttttccagcaatgattacctcggcttaagtcaacatccgcagattattcgcgcctggcaacaggcagcgacgcgttttggcgtcggcagcggcgggtcgggtcatatcagcggttattccgtggcgcaccaggcgttagaggaggaactggcgcaatggttaggatatccacgcgcgctgctgtttatctctggctttgcggcgaatcaggcggtcattaccgccttaatgaaaaaaaatgaccggattgtggccgacaggttgagtcatgcttccctgctggaggccgctaatctgagtccggcgcagcttcgccgctttatccataacgatacgcagcatctgtcgcgtttactgcaatcgccctgcgtgggtcagcaactggtggtgacagaaggtgtatacagcatggacggcgacagcgcgccgctggcggaaatccagcacattgcccgcaggcatcatgcctggctgttggttgatgatgcgcacggcatcggcgtgactggcgatgaggggcggggcacctgctggctgcggggggtgaagcctgagttgctggtggtgactttcggtaaggggtttggcgtcagcggcgcagcggtgctctgctcggaaagcgtcgcggattatctgctgcaatttgcccgtcatctggtttacagcaccagtatgccgcccgcccaggcgcaggcgttaagcgcctcgctggcggtgatccgtagcgatgaaggtggtgaacggcgcgaaaaactcgccgctctggttcagcgctttcgggccggcgttaacgcgtcccgatttacgctactgaatgcccatagcgccatccagccgttaatcgtgggcgataacagccgtgcattgcgcctggcggaggcgctgcgtcaacaaggatgctgggcgacggcgattcgcccgccgacggtgcctgtcggcacggcgcgcctgcgcttaacgttaacgcaggcgcatgaagcgtgtgatatcgaccgtctgctggaggtgctgcatggcgcaggtgaataagcaggctattgcggcggcgtttggccgggccgcatcgcaatatgaacagcacgcctctttgcagcaacacagcgcggatgcgctgctgacgctgttgacaggccgccagtttgccagtgtgttggacgcaggctgcggccccggacgtatgagtcgttactggcgagagcgggggagcgaagtgaccgccctggatctttctctgccgatgctgcaacaggctcgcgatcgtcaggcggcgcatcactatttgctggcggatatcgaagcgattccccatgacgccgaagtttttgacctggcctggagcaacctggcggtccagtggtgtggcgatttacgcgatgcgttgagcgagttgtatcgggttgtacggcccggcggcgtggtggcgtttaccaccttgtgccaggggtcgttgccggagctgcgtcaggcatggcaggccgtcgataatcgcgctcacgcgaatagctttttgccggaagaggccattgaccacgcgctgcgcggctggcgggcgtttcgtcatactcaggcgatgacattgtggtttgaggatgccctgagcgcaatgcgctcgcttaaaggcattggcgccacccatcttcatgaagggcgggagtcggatgtattaacccgcgcccggcttagacagattcaactggcatggccgcagcggcaggggaaatatccgctgacgtaccatctttttatgggagtgattgaacgtgactaaacgctattttgtgaccggtactgatactgaagtcggtaaaacggtcgccagttgcgccttattgcaggccgcaacgcagttaggttatcaaaccgtaggctataagcccgtcgcttccggcagcgaaatgacaaccgacgggctacgcaatagcgatgccctggccttgcagcgtaacagcagcctgccgcaaccttattccgctatcaatccttatacttttgccgagcctacctctccccacatcgttagcgccgacgaaggccgggcgatagacgcggcggtgttatcacgcggattgcgaacgctggaggcgcaggcagactgggtgttgacagaaggggcgggcggctggtttacaccgctctctgccacgctgacgtttgccgactgggtacagacggagcagctgccggtgattctggttgttggcgtcaagctgggctgtattaatcacgccatgctgacggcgctggcggtagaacaggccggattaccgcttgtcggatggatagccaacgacatacagccgccaggcgcgcgtcatggtgaatatctcgcgacgcttcgccgcgtcataccggccccgctattaggggaaatcccgtggctgggcgtttctccatcgcaggcggcgacaggacagtatctggaccttagccccctggaacgcgcctgactgcgcttaaaaactgccttcttgcaggatcagacgatcctgctgttttttcgccagaccttcctgacgtcgccatgctaaaaatgtgcaaaatgtgagcgtctacgcctcaatttttcccttctcgttagccaataatctgccaaaaatagcgataatttttttttatcgcccggcgaaaacgtcaggagctgattttgccaggcggcaggggatacgggctggaagcagttatccactattcctgtggataaccttgtgtattagagttagaaaacacaacgtaagcgagaggcgacgcggcctgcgactaaattggcgcgaaagacggcttgagaaaatatcccttttcagacagcaagttatataaaatcaatggttgtaaaggaagggggatacgttgacataaaactttcatcatccgacttgacaaatgttaaaaaagactctggtctggggataaccagcacactgctggaattttaccccgcgactgtctatgttttacctctaaatagcgtggggtatctgccgatagccattatacactggagtgttactgttttttcatccagtattttttattggcaatattcaccgtcgagagtaaaattacacccctgcccgctcactccttcaggtagccgctcatgagtaaaccgttcaaactgaattccgcttttaaaccttctggcgatcagccggacgctatacgtcgtctggaagaggggctggaggacgggctggcgcatcagacgttattgggcgtgaccggctccgggaagacattcaccattgccaacgtcattgcggacttgcagcggccaacgatggtgcttgcgcccaataaaaccctggcggcgcagctctacggcgaaatgaaagagtttttcccggaaaacgcggtcgagtatttcgtctcctactatgactactatcagccggaagcgtatgtgccaagctcggatacgtttatcgaaaaagacgcttcggtaaacgaacatattgagcaaatgcggttgtcggcaacgaaagcgttgcttgagcgacgcgatgtcgtggtggtggcttccgtgtccgcgatttacggtctgggcgatccggatctctacctgaaaatgatgctgcatctgacggtgggaatgctgattgaccagcgcgcgattttgcgtcggctggcggaattgcaatacacccgtaacgatcaagcttttcagcgtggtacctttcgcgtgcgcggcgaagtgatcgacatcttcccggctgaatctgacgacatcgcgctacgcgttgagctgtttgatgaagaagtggaacgcctgtcgctgttcgacccgttaaccgggcaggtagagtcaacggtgccacgttatactatctatcccaaaacgcactacgtaacgccgcgcgagcgtattctgcaggcgatggaagagataaaagatgagctggcggacaggcgtaaggtcttgctggcgaataataagctgctcgaagagcagcgattaagccagcgcacgcagttcgatttagagatgatgaacgagctgggctactgctcaggcattgaaaactattcccgctttctgtcgggccgcgggccgggcgaaccgccgccaaccttgttcgattatctgcccgccgacggactgctggtggttgatgagtctcatgtcaccatcccgcagataggtggcatgtaccgcggcgaccgggcgcgcaaagagacgctggtcgagtatggcttccgtctgccttcggcgctggataaccgtccgctgaagtttgaggagtttgaagccttagcgccgcaaactatctatgtttccgccacgcccggcaactatgagctggaaaaatctggtgatgaggtggtggatcaggtcgtgcgaccgaccgggctgctggacccgattattgaagtgcgtccggtggcgacccaggtggacgatctgctgtccgaaattcgtcagcgtgcggccattaatgagcgtgtccttgtcactacgcttaccaaacggatggcggaagatttgaccgaatatctggaagagcacggcgagcgcgtgcgttacctgcactcagatattgataccgtggagcgcatggaaatcatccgcgatttgcgtctgggcgagtttgacgttctggtggggattaacctgctgcgcgaagggctggatatgccggaagtctcgctggtggcgattctggacgccgataaagagggcttcctgcgctccgagcgctccctgattcagaccatagggcgcgcggcgcgtaacgttaacggtaaagcgattctgtatggcgataaaatcacgccgtcgatggcgaaggcgattggcgaaaccgagcgacgtcgcgagaagcagcagaagtacaacgaagagcacggtatcactccgcaggggctgaacaaaaaagtggtcgacatcctggcgctggggcagaacattgcgaaaaccaaagcgaaggggaaaggcaagggccgttctacggcaaaagccggaattgtcgaactggatatgacgccgaaagcgttgcagcagaaaattcatgaactggaagggcaaatgatgcagcacgcgcaaaatctggagtttgaagaagccgcgcaaattcgcgaccagttgcaccagttacgcgagttgtttatcgcggcgtcctgacaatgtgtcgatcgccagcgagtcatcgttaccatggctcgcttttgagaatttcagtgcaatagtaagggctaagtcagtcaggaatgaaaaacagtgacaggctttgactaacgggattgtcgaaaaactcaaaacatcaatggggtagctagtttaatcacaactgaagaaaattagcgttgaggctgaacccaacgctaattttccctctctcctcggctatgaaaaaaaacgccccgtattatcggtatagctatccttatgatcgtcattttaatcttatatgagttcgttgaaagcgtgtcatggcaacagattacatcattctacttaaaaaagaggtgatggaagcgcgagcatctataagtcaagcgctgcaaatactgaatgatttgtccgaaataatgacgactgtgacctcttatttaaagttgagaatatccttatctgttactttaggttacgttcagatcaggtagggaaaatatgtttaatattactaatatacaatctacggcaaggcatcaaagtattagcaatgaggcctcaacagaggtgcctttaaaagaagagatatggaataaaataagtgcctttttctcttcagaacatcaggttgaagcacaaaactgcatcgcttatctttgtcatccacctgaaaccgcctcgccagaagagatcaaaagcaagtttgaatgtttaaggatgttagctttcccggcgtatgcggataatattcagtatagtagaggaggggcagaccaatactgtattttgagtgaaaatagtcaggaaattctgtctatagtttttaatacagagggctataccgttgagggagggggaaagtcagtcacctatacccgtgtgacagaaagcgagcaggcgagtagcgcttccggctccaaagatgctgtgaattatgagttaatctggtctgagtgggtaaaagaggcgccagcgaaagaggcagcaaatcgtgaagaagccgtacaacggatgcgtgactgcctgaaaaataataagacggaacttcgtctgaaaatattaggacttaccactatacctgcctatattcctgagcagataactactctgatactcgataacaatgaactgaaaagtttgccggaaaatttacagggaaatataaagaccctgtatgccaacagtaatcagctaaccagtatccctgccacgttaccggataccatacaggaaatggagctgagcattaaccgtattactgaattgccggaacgtttgccttcagcgcttcaatcgctggatcttttccataataaaattagttgcttacctgaaaatctacctgaggaacttcggtacctgagcgtttatgataacagcataaggacactgccagcacatcttccgtcagggattacccatttgaatgtgcagagtaattcgttaaccgctttgcctgaaacattgccgccgggcctgaagactctggaggccggcgaaaatgccttaaccagtctgcccgcatcgttaccaccagaattacaggtcctggatgtaagtaaaaatcagattacggttctgcctgaaacacttcctcccacgataacaacgctggatgtttcccgtaacgcattgactaatctaccggaaaacctcccggcggcattacaaataatgcaggcctctcgcaataacctggtccgtctcccggagtcgttaccccattttcgtggtgaaggacctcaacctacaagaataatcgtagaatataatcctttttcagaacgaacaatacagaatatgcagcggctaatgtcctctgtagattatcagggaccccgggtattgtttgccatgggcgacttttcaattgttcgggtaactcgaccactgcatcaagctgtccaggggtggctaaccagtctcgaggaggaagacgtcaaccaatggcgggcgtttgaggcagaggcaaacgcggcggctttcagcggattcctggactatcttggtgatacgcagaatacccgacacccggattttaaggaacaagtctccgcctggctaatgcgcctggctgaagatagcgcactaagagaaaccgtatttattatagcgatgaatgcaacgataagctgtgaagatcgggtcacactggcataccaccaaatgcaggaagcgacgttggttcatgatgctgaaagaggcgcctttgatagccacttagcggaactgattatggcggggcgtgaaatctttcggctggagcaaatagaatcgctcgccagagaaaaggtaaaacggctgttttttattgacgaagtcgaagtatttctggggtttcagaatcagttacgagagtcgctgtcgctgacaacaatgacccgggatatgcgattttataacgtttcgggtatcactgagtctgacctggacgaggcggaaataaggataaaaatggctgaaaatagggattttcacaaatggtttgcgctgtgggggccgtggcataaagtgctggagcgcatagcgccagaagagtggcgtgaaatgatggctaaaagggatgagtgtattgaaacggatgagtatcagagccgggtcaatgctgaactggaagatttaagaatagcagacgactctgacgcagagcgtactactgaggtacagatggatgcagagcgtgctattgggataaaaataatggaagagatcaatcagaccctctttactgagatcatggagaatatattgctgaaaaaagaggtgagctcgctcatgagcgcctactggcgatagctgaacgcagtttatcagaagagggagagagcctgtttacccttcggtgtaaacaggcttctgataagcgcagcgtcgtcggtaaacgggcttaacccaacgcctgtagcgctttttccagcgcattatgtaataactgacgatcgtggcgataggggatatcgctggcctccagcacttcctgaatcaccagccgatcgttcaccgcactgacgtcaactcgcggcccaaccactactgcgtcaatgacttttttgccaatatattgctccatcatcgccagcttatcgaccagcgttaaactggcggcgggcagactcagttcgcgacccagattgccgatatacaccattggcgctggggtgcgccgcagcgcctgcgccagttcatccagcagcaggcaaggcatcaggctggtataaaaactgccagggccaatcagaatcagatccgcgtcattaatggcctgtaccgcttcccgcgtcgccggaacgtttggcgttaacatgatctcctgcggcggcgtcgctaactgatcgatattcacctcgccataaatctcatgcccctgatcgtcaatcgccatcagatctaccggtagctccgacatcgggatcagctgcgcgtccactttaagcagattacgaattaaattaatcgcttccagaggccgcacgctcaggtgatctaacgcctttaacatcaaatttccgaggttatgaccagaaagttcgccattaccgccaaaacgatactcaaacatagcggacgcgacgctaggttcggtaattaactgattcagacagttgcgcatatcgccccaggcgatcccgccttccgagcggcgaatacggccagttgaccccccgttatctgtggtagtcacaatgccggtcaggcgcgaacctaatgaagaaagcgaggagaggacgcgtcctaatccatgccctccgccgagggcaacgacacgatcaaggtcagccagcgtacgattgcgcataaaaattcctgaagtcaaataagcagcgctacagtagcgcaagtcgcgggttttcagcaattagccgaccggctaaaagacaattaattattcccgactacccctttatagcgagggcgttaccacggctaaatgatatatatcaatgtaaaagtgtgattttcacgtattctgtcgctaaatagcacgatcatatcgctatgtatatgtttatatagcgaaagcgtgatggcgaaattgtcatttacacgctagtatcggcgtaaccacagtaaacactctagcctctgcacctgggtcatttttgatacggtgctttggccgtgacaacgtttaacgtttgccaccagggcgcaggaagaaatgactccgcctcccgtatttggaaaggtgtacatggcttcacaacttaccgatgctttcgcgcgtaagttttactacttgcgtttgtcgattaccgatgtgtgtaactttcgttgcacctactgtctgccggatggctacaaacctggcggcgtcactaacaacggtttccttaccgtcgatgaaattcgtcgcgttacgcgcgcttttgccagtcttggcacggagaaggtgcgtcttaccggcggcgagccttcattacgccgcgattttaccgacatcattgccgccgtgggtgaaaatgatgctattcgccagatcgcggtgaccactaacggttatcgactggcgcgcgatgccgcgaactggcgcgaagcggggctgacgggcgtcaatgttagcgtggatagtctggatgcgcgtcagttccatgcgattaccggtcaggacaaattccgccaggtgatggcgggcatcgatgccgcctttgacgccggtttcgaaaaggtgaaagtcaacaccgtgctgatgcgcgacgtgaatcaccatcagttggataccttccttgcctggattcagcctcgccccattcagctacgcttcattgaacttatggagacgggcgaggggagcgatctcttccgcaaacatcatatttcgggtcaggtattacgcgacgagctgattaagcgcggttggatccaccagctccgccagcgcagcgatggcccggcgcaggttttttgtcatcccgattacgccggtgagatcggcctcattatgccgtatgaaaaagatttctgcgccacctgtaaccgcctgcgtgtttcgtccgtcggtaagctgcatttatgtctgtttggcgacggcggcgtgagtttacgcgacctgttacaggatgacgcgcagcaatacgcgcttgaggaacgtatttccgacgcgttgcgggagaaaaagcagacccactttcttcaccagagcaatactggtattacgcaaaatttatcttacattggcggttaatccttaataaggagatttcagatgagtcaggtcagcgctgaatttatcccgacccgcatcgctattcttactgtttccagccgacgcggcgaagaagacgacacctccggtcattatctgcgtgattcggcgcaggaggccgggcatgaagtggtggcgaaagccatcgttaaagagaaccgttacgcgattcgcgcccaggtttccgcctggatcgccagtgatgaggtgcaggtcgtattgataactggtgggaccggtttgaccgaaggcgatcaggcgccggaagcgctgttgccgctgttcgatcgtgaagtggaaggatttggcgaagtgtttcgcatgctctcgtttgaagagatcggcaccgcaactctgcagtcgcgcgcggtagctggcgtggcgaataacaccttgattttcgccatgccgggctccacaaaagcgtgcagaaccgcatgggagaatatcattgcgccgcagctggatgcccgtacacgcccatgtaattttcaccctcatttaaagaaataacgatgtcgcaattaacccatataaacgccgcaggcgaagcgcacatggtggacgtttccgcgaaagcggaaaccgttcgtgaagcgcgtgcggaagcattcgttaccatgcgtagtgaaacgctggcgatgattgttgatggcaaacaccacaagggcgatgttttcgccaccgcccgaattgccggtattcaggccgccaaacgcacctgggagctgatcccgctgtgccacccgctactgctaagtaaagtggagattcagcttcaggccgagccggagcataaccgcgtgcgtattgagtctctgtgccgtctgaccggtaaaaccggcgtcgaaatggaagcgttaaccgcggcgtccgtcgcggcgttaaccatctacgacatgtgcaaagcggtacaaaaagatatggtaattggtccggtgcgcctgctggcgaaaagcggcggcaaatcgggggattttaaggtggatgcgcatgattaaagtgcttttcttcgcccaggttcgcgagcttacaggaactgacgcgctggatcttccagcagatttttccaccgttgagtcgctgcgacagcatctggcgacaaagagcgatcgttgggcgctggcgctggaagatggcaagctgttggcggcggtcaaccagacgctggtaagttttgaccatccgctgacggcgggcgatgaagtggcgtttttcccgccagtcacggggggctaacatgcacgaaacgcgaattgtagtcggccctgcgccgtttagcgtcggggaggaatattcctggctggcggcgcgcgacgaagacggcgcggtcgtcacctttaccggaaaagtgcgcaatcataacctgggcgatagcgttaaggcgctgacgctggagcattatcccggcatgactgagaaagctctggcggagatcgtcgcaaaggcgcgttcccgctggccgctggggcgggtcacggtgattcatcgcgttggcgaattatggccgggcgatgagattgtgtttgtcggcgtcaccagcgcgcaccgcagtagcgcgttcgacgccggtcagttcattatggattatctgaaaacccgtgcgccgttctggaagcgtgaagccacgccggaaggcgatcgctgggtcgaagcgcgcgacagcgaccagcagttggcgaaacgttggtagcagaatgtgatacgctttagggtatcatttccacacaggagttcatcatggacagatttccacgatctgattcaatagtgcaggcgcggtccggcctgcagacctatatggcgcaagtgtatggctggatgacggtcggactgttactgaccgcgtttatcgcgtggtatgcggctaatacgccagccgtcatgatgtttgtcttttccagtaagatcactttctttggcttaattattgcccagcttgcgctggtgtttgttctgtcgggactggtgcataaacttagcgccggaatggcgacgacgctgtttatgctctattcggcgctaaccggattgacgttatccagtatttttatcgtttacacctactcctctatcgccagcacgtttgtggtgacggggggaatgtttggcgccatgagcctgtacgggtacaccactaaacgcgatcttagcggtttcggcaatatgctgtttatggcgcttattggtatcgttctggcgtcgctggtcaatttctggctgaagagtgaagcgctgatgtgggcggtaacctatatcggggtggtggtgtttgtcggtctgaccgcctatgacacgcagaaactgaaaaatatcggcgagcaaatagatacccgagatagcgctaatctgcgtaaatattcgattctcggcgcgttaacgctgtacctggactttatcaacctgttcctgatgttactgcgtatttttggtaatcgccgctaattatagcgatctcttaaaatcctggccctgcgccaggattttttttaggactatatttagggcgaaacagcataaatatcttagaaatgttttcctacgcttgccattcttatcaccgtgatcatgtgaagagtgataaatgacaagtgggacctctggctgcaatacgtatacgacaaatagcatttattccctcgacaatgttatcccttacctattggtatactgcgttgggactatggtgtaccgccggcattatatggttaacgttgtatagtcattttttaataacccacgttcaacctgttgttgttttgtggatatcagcacttttgcttggcctggggtatggggccattacctgtctttcccgctttggcactgttgtcgcaacgttgatatatattgccatcattacgcttaccggcgtgtcattagcttaccttttctcaggtggcgcgaccattttcgtgattgttggaatcatgtttagtcttaatgccttatttattttctacctgaatatcagttctggtctattcaggccgttaatttttatggcggtaagcgggatcatcgctgcgatagttgtcaatagcctggtggccagtagcactctggtctggatagtcagtgtgctgacggtattggtatggacattgattacagcactagaaaaatcgacacttcatggttatgcccgcatgttataccacagcgagttttcatcgctgcctcgttgcgctttatttggcgcgctgacgctttaccttggcattattaatgctgtggttacgctgtgtcgttatatcattttgatgattctggaaatactattatctttcaggccgtaggcgttgcaggttttttattcaggttggtgatgatgggtataatgagtaaattatgtggcaaacaattttggttagcgttttgtgaagctaaagacgtcactcgcgccattaaaaatggcggcgaggattttaataagaaatgcccaccagcgctgatttctcatttcattaccggattgtcatgggaacattcattacccaatcctgcgcctgtttgcgcgtttagttttatgcttcttgtgggaggtgtgtgcagtgcgcattttgtttttgataagtttatcctgtattggccactaaatataattatttattttggcagtgctataggtattatgctatgtgttatggccgaggtatggcttattgccaaaggctttattctggggttgcgcctctgcgttttactgtttttgttaaatattatgctctgcggtactggattatttgacgtgttgtgccatcaaaatagcgaactaaagagtgatcttgttatcgcgattattatggttgtgctttgccgctgggtgatgaatggcgaaacgtttacgatgatgattcgtttctgcctggggcgtcgattagtgcgagttgcattacaaaaatatctcacctcacagacaaggaaatgataagcccatgaacctgatgacgtggctaacaggaaaaacactggcggagctggtgaaaaaagggcagttgatcccgccagaaattaagttacctgtgtatccggccagccactacaaaaaaaactggtatgaacaaggtattcctcacggaggcgttattgggcttacggcgatcatgatgaccatgacatggatcgtcagtataaacatggttattgcgcagtttgagctgcacaataaaaagcatctggagctggtcttcttcctggccgtgggctatatcgcttttcttaccccgtcaaatcagctcctgcttaaaggaagaatgagcggggttattatttaccgctatgcgctattactggtcattatttccgttacgttggcaacgttctgtaccctgtcatcagtattcatgggcgagtttcacgaagtgctcctgctgctgtttagctggtcattgctgcttttttcccgcttacagatgaatacgtcttttttctcagcatatgtttatttttaccggataaaacgcgttgtgctggaaagcgaaaacgcgtctgcttaaatttatttcgccatcgcccgctcgtttttcgcccgcagcttcttcgcccggctctccaggatcagatagcacaccagcgccagcaacaggggaataaaatagtaaagcacgcggtatgcgagcagggcggcgataatcgtgccttgcgacgtatgttcgcccgccagcaacgcaaggaatacggcctccagcacgccgatgcctgccggaatatgcacgatgacgcccgcgatactgctcaccagcagtacgcccagcacaaagaaatagttcacatcctgacccatcagcagccagatgatggcgcccatcgccatccagttcgcgctggagatcgccatctgcgccagcgcgaatttccatgacggcagcaccagtttctgtcctttaatcgtcatatgccgccgcttcgcaaaggcgcaaaaccacagatagaccgcgataatcaacaataaaacgataccgagaattcgtagcgtgcctgcatcgatataccagtggtcgggaagctggacaatgccgaaggtaaaaatgatgccgccaagcagaatatagcccagccagttagtggtaatgctgagtgagaaaatgcgcgtgatagtactgccgggcaacccgaggcgagagtatagtcggtaacgcatcccgatcccgccgacccaggtgctgagcgtcaggttaaaggcatagcagacgaacgataccaacatcacctgtcgcttcgccagtttatggccgcaataaagccgtccaagcaggtcgtagcagccgtacagaagatagctaacgatcaccagtcccacagcgcttaaaagcgccgtgcggttatagtcacggatgacggtccagacatcgccccagtcgacctttttagcataaaccaccagcagaacgacgaccgcaataaaaaacagccaggtcagcacttttttagccagccgccagcgcggatgcgatttagccattagggcttcactcctgtattttctggatcaacgcgatcctgggtttccatttctggctgggcaggcgggggaacctgcgccagatgcggggtatgcgccggtagccagccgaccagcgccgggaaatgacgtaaaaagtggaacgccagcacgcttttggtcaggttccaccaggtgcgtttcggcagcatagactcatcgacctgcttacaatcgttcacgatgatgccttgtaagttatcgcgcagggtctggttaaaagtacgatcgtgaatgatcaggttagcttcaaggttaagcgacaggctgagcggatcgagattactcgaccctaccgtggcccagtgatcgtccatcagcgccactttgccatgcagcggacgtcgtcggtattcataaacctgcacaccgcccttcaccagatagttatagagcaaccgcgcgccgactttgactatcggcatgtctggttccccctggacaatcagttttacgctcacgccacggcgggcggctttacgcattgcgtggagcaagcgatagccggggaaaaaataggcgttagcgataatcacttcacgctttgcctgggtcagcattttcagataatgacgttcgatatcgtcgcggtgttcttcattatcccgccagacaaacagcgcctgcgcttcgccggggtggcgattttcttcagcctgatgatggcgcttccaccagcggcgcgcggggctttgccccggcagattctcgacttcgaattgcaggatatcggccactacaggcccttcgacccgtaccgcgtagtcttgtttcgcctgcgggccgtaatccgacatatgttcggcggagtagttaatgccgccgacaaaggcaatacgatcatcaatcaccacaattttgcggtgcattcggcggaagatattggttcgcaaccccagtagacgcgggcgggggtcgtaatagcgaaaaatcacgcccgctgaggtcaattcgccgacaaacgcgtcgctgagatcgggagagccgtagccgtcgagtaatacttcggcttttacgccgcgctgtgcggcttttagcagagcggtatggagttttttacccacctcatcttcaaacaagataaaggtttccagaatgattttttgctgtgcctgagcgatagcctcaaacacggcaggatagaactggtcgccgttttccagtagctgaatttgattaccttcacgccagccgcatttcatagatggatctccgcgctaaggggggcatggtctgataaatgtcgccagttccgcagcggcagcgccgtaggagaactggcgttcgcattcttgacgtaaatacgatcgagtcgcagcagcggcatactcaccgggaatgtgcgcgccggtcggccatgggcacgggtgaatatctcctccagcccggccgcgtttaacggcgggccggccttttgccgccagtcattaaagtctccggccaccagcaccggttctgattccggcaaggcattcacccatcccgccagcatggttagctgtgcctggcggtgactctcccgcaggccgagatgtacgcacatgacgtggatagggcggttgagcatgggcggcgtaatgcggcaatagagcacgccgcgtttttcgctaccgccgaccgagacgtcgcgattttcataatgttcaatgggatagcgagaaagaaccgcgttaccgtgatggccttccggatagaccgcattgcggccataggcgaaatcgctccacatggtgtcggccaaaaattcatagtgggtagtgtccggccagttttcgatatgcagcggatgtacttcatgcgcgcccatcacttcttgcagacagacgatatcggcgccgaccgttctgacagcgtcgcgcagctccggcaggatgaagcgtttattaaaggcggtaaaacctttgtgcgtattaattgtgagcactttgaatgaaaaatttcgcgtgtgttgagtcattttcttcctgtccgcgtcactatcctgattgaaatagtgtagtcgtcgtcacaaaaagatgcggtcttacggaattttccgtaaagttcggtactctgaataatgagagaaaaatgcttcaggagaaaagccatgaagtggcaacaacgcgttcgtgtcgcaaccggcctcggttgttggcagattatgttgcatttactggtagtggcaatgctggtaataggctggatgagcggcacattagtgcgcgtcggcctgggattatgcgtgctttatggcgtgacggtactgctgatgctggcgttgcagcgccatcatgagcaacgctggcgcgatgtggcggatgtgctggaagagctgactaccacctggtacttcggcaccgcgctgattgtcctctggctgctatcccgcgtcttgcaaaacaatgttttactggcgctggcggggctggctatcctggccgggcccgccgtggtctcgctactggcgaaagataaaaagctacatcactttgcgtctaaacatcgcatacgccgctgaacccgtggtggccgctatcaccagtagcggccacaaacttccccagacaatccccagactcgcgtccttaagataaatttgcttagtaatatcagtaaagtggcggataggatttatccacgtcaggttttgcagccagaccggcatattttccaccggcgagacataacccgagagcaaaatcgccggcatcataaagacaaagacgccgataaacgcctgctgttgcgtggcgcaaagcgatgatatcagcaagccaaagcctaccagcgacagcccgtaaatcaccatcgtgaaataaaacagcgctaacgaaccggcgaagggaatttggtatgcccaaatgccgatagccagcacgatcgtggcctggaaggtcgcgacaatcagcgccggcaccgctttaccaacgaaaatctgccaggtggtgagcggagagaccagcagctgatccagagtgccttgttcacgttcgcgggcgacggacagcgaagtgacgatcatcacgccgatagtggtgatcatggcgatcagcgagggcaccacaaaccacttgtagtccagattcgggttataccagttgcgtaccaccagttcgctattgttgggctttggcttgccgtccatcaatgtctgctgatactccttgacgatctgttgcagataattggcggcgatttgcgcgctgttggagttacgtccatcaagaatgagttgcatcggcgcaggctggaaggtatccagattccgcgagaaatccgccgggaagcgtaccagcagcagcgctttttgcgtatcgatagtcggctggatctcctgcggactgttcagcaatagcacatgggtaaacgctttcgcgcgggcaaagcgctgggtaagttctaccgaatgtttgccgttatcttcgttatagatggcgatagtcgcgttagtgacttcaagcgtcgcggcgaacggaaacaggatgacctgaatcagcaccggcagaatcaggatcgcgcgcgtttgcggttcgcgtaaaagcgattgcagttctttgcgaattaacgtccataagcgatgaaacatgtccgtcctctcagtccagtttgtaggcctgataagcaaagcgcatcaggcataatgccggatggcggcgtgaacgccttatccggcctacgacgacaattatccatacacatatttaatccagccgtcgtttggtttttagccacgtcaggccaataaacatcaccgccgaggcgattaaaaacagtacgttaacgcctaacacgaccggaatattgccggccagaaacagactttgcagggtgctgacaaaatagcgcgccggaataatataggtcaccgcgcggatcaccgcaggcatactgtctatctggaagataaatccggacagcataatcgagggcaaaaacgcggcgttcagcgccacctgcgcggcgttaaactggttgcgagtgatggtggaaatcaacagccccatccccagcgtactcagtaaaaacagactggtgatgataaacagaatcaccagcgaaccgcgatacggcacgccgagaataaacaccgataccagcatacagagcagcatcgccagcataccgagaaagtaatagggaataagcttacacagcagcagttcaacacgcgtcacttcggttgagagcagcgcctccatcgtgccgcgctcccattcgcgggcaacgaccagcgaggtgaggattgcgccaattaccgtcatgataatggtcaccgccccgggaataataaaatgctgactgatcgccgccgggttaaaccagtagcgcgtctggacgtcgatgagcggttcaaaggtgtcgccgcgatcttccgcgcgctgctgttgccagatttgccagatgccttccacataaccctgaacgaagttggcggtgtttggctcgctgccgtcggtaatcacctgaatcggcgcgctgtcaccgtcgcgcgccatttgctgcgcgaaatccaccggaatcaccaccagtccgcgaatgcgtccggcctgcattttttcaattaattcatggcggttatcgctaatggtcgcgtcgatatagggtgaaccggtcatcgcatgagtgaaatccagcgcctcctggctttgttgttcaagcagaatccccacccgcagtttgctggagtcgaggttaatgccgtaaccaaaaataaacagcaacagcagcgggatcaccaccgcaatcagccagctactgggatcgcgcacgatctggcgcgtctctttgacgcacaacgcacgcacgcggcgccaggagagagacttactcatgcgtatgctccttatcccagtcattgatgagagtgataaaggcctgctccatcgttggatcggcctgttgctcatcggcggcctgcgctttgagatcgtccggcgtaccgctggcgataagcttcccgcgataaaccagtccgatgcgatcgcaatattccgcctcatccataaagtgggtcgtcaccattaccgtgacccctttttccaccatgctattaatatgcagccaaaattcacggcgggtgaggggatcaaccccggacgttggttcatcaaggaataaaatatccggttcgtgcatcagcgagcaggccagcgccagtcgctgtttaaagcccagcggcagcgcatcggtgggatgcgacgcgatgcttttcagaccaaacgcttcactcatgcgctgaattttttcattttgcgcgcggccccgcaaaccgtagacgccggagaaaaaacgcaggttctgctcaaccgtcaggttgccgtaaagcgaaaatttttgcgccatatagcccagatgctgacgggctttgccggagctgactttcaggtccatatccagcaccagcgccttgccggacgtcggcaccagcaggccgcacatcattttaaaggtggttgatttacccgcgccgttcgggccgagcaggccaaaaatctcgccgcgctgtacgacgaaattaacatggtccgtagccgcgaaatcgccaaattttttcgtcagttcctgcgcttcaatcaccgtttcgccggcagtgccttcaaccgtatgcaggattgaacccagcggagactccgaggttcccgctccgccaagcagatcgataaacgcatcttcgaagcgcggcgcggtctcattgagggtgatttccggcatcccttcggcctggcgaatatctgctgcggtcgcctcttttttcaggatcaggcgtaccgaacgtccctgaatcatgccgtcgctcacctgcggcagtctgagcgctctctgtagcaacttacggttgttttcctgtggactactcatcagaaagctacgaccggccatcgtttgcgtcagcgctttaggttcgccctgatagagcagctcgccttcattcatcagcagcacatcgcgacactgttcggcttcatccagataggaggtgctccataaaatcagcatcccgtcgcccgccagttcgtgaaccatttgccacaactcgcgccgtgaaatcgggtcaacgccaacgcccggttcatccaacagcagcactttcggttcgccgaccagcgtacaggccagccccagtttttgcttcatcccgccggacaatttccccgccagacggccagtgaaagggccgagggcggtaaattccaacaaacgggcaaaggtcttttcccgtatctcgccggtaacgctgcgtaaatcggcatagagattaaggttctccatgacggtaagatcttcatacagaccaaatttctgcggcatatagcccagaaccgcgtgcagctcgctgtcgttttgtatcgggtcgaagcccaatacggacgcgctgccgccatcggctttgagcaggcctgccagcatacgcattagcgtggtttttcctgcgccgtccggccctaccagcccggtgacataaccggaatgaatggtacagtcgagcggcgcgacggcgggtttatccattcccgcaaagcgcttcgtcagaccgtgcagcgtaataacggcctcactcatgccgtgcctcgtcattaaatttcaccgtgactggcatcccctggcgtaacgcatcgtccgcatcggtgacgataatgcgcaggcgatagacgagatcggtacgcagatccggcgtttcgacggttttcggcgtaaattccgcggtgggcgaaacgaaaccaatcttgccgtggtaaggtttgtcaggacgaccgtcggtatacaacagaatgtcgcgccccggttgcgtctgactgaggttgcgttcatcgacataggcgcgcacccagacggggcgggtcagcgagagcgttaataccgtgctgccggcgttcagcatactgccaggctcgaccgcgcgggtgagcaaggttccgttggcaggcgcgataagcgtggtgtcctgcaaatcaagctgcgcctgcgccagttgggcctttgcctgttccaggctggctttcgcctgggcgatatcctgttcacgattaccggtacggtactggctcagtttatcctgcgcggacttcagcgtcgcctgcgcctgatcgcgcgatgagcgggcgttttccagatcgttagcggaaatggtgcggcttttccacaatccttgctgacggttataaaagttttgtgcgtagtcataggcggcttgcgcctgtctgacggcggcggcggcctgggctatctcttcatcgcgatagcctgccagcatcaaatcatattgcgcctgcgcgaccgacacgccagctttcgcctgcatcagcgcgttttcgtatggcgcgtgatccagttcgccgagcacctgtccggctttgatagtatcgccttcatcaacattcagcgacgccagcctgccgccgacgcgaaagctgatattgacggtacggatatcgacattaccgtatagcgtcagcccatcgtcctgccgactttgataccaccaggttccaccggcaatcacagcgacgatcgctgcgattgccagtccgataacgacaggttttttcatcagtccagactcctttgcgttaaaccgtgcagaataagatcgatgtggcaggttaccgtctggtaaatcagctccgctttttcttcatcaaactgcggccagccggtacgtaacagaatagtttctttgccgagacgaaacgccagcacttcgcccagtaaggcatgggtatgcaaaatcatgcgcgtatcattggcgtcgcagccggtataagcggcaaccaatcttgtcagatgggtgtgcaacggatcgataacctgttcatggaccaattgataggccgacgtgggagagagctgctcgcgtgaaataaatttgctcaggttaacggtgtcttcctgcgtcagcagcataatcatgttcttgcaggcgagcagaatgagttcgcgtatggcgtcccggtcaggggcaggctggctaaacagacgctccgctttttcagcatgcgggcgaaatttttcgccaagaaaatcggcaatccactgggcgcaggcgaggtataaatcctcttttgagccgaaatagtaagtaatggcggcaatattttgccccgccagcgcggcgatatcgcgcgtggtggcatggaggccatactcgccaaactgcgccagcgcggcggcaatgagctgacttttcgcctgctcgcccttggtggtcgtggtgggaatattcatcacacgccctaatttttaatcaatcgattgattaagactatgactcataatggcacttgtccagtgtggtcgattaatttgtctttgctaccttccgggataatttatgcgccgcatcacaaaaactgctacactccgccccttcatgacattgtggtttttgtcattccaaatttgagcatctccctgaaaactacaccggcaacggtcggggcggtccggagtagttatgtcttttgattccctgggattaaaccctgatatcctgcgcgccattgccgagcagggttaccgtgaacctacccctattcagcaacaggcgattcccgccgtgctggaaggccgcgatctgatggccagcgcccagaccggaaccggtaaaacggcgggttttaccctgccattgttgcagcatctgattacccatcagccgcatgctaaaggtcgtcgcccggtgcgtgcgttgatcctcacgccaacccgcgagctggcggcgcaaattggcgaaaacgtcagagattacagtaaatatctcaatattcgctcgctggtggtatttggcggcgtaagcatcaatccgcagatgatgaaactgcgcggcggcgtggatgtgctggtggcgacgccgggacgtctgctcgacctggaacatcaaaatgccgtgaagctggatcagattgagattctggtactggatgaagccgaccgtatgctggatatgggcttcattcacgacattcgtcgcgtgctggcgaaactgccggcgaagcgtcagaatctgctgttctccgccacgttctctgacgacatcaaagcgctcgccgaaaagctgttgcgcaacccgctggaaatcgaagtggcgcgccgcaacacggcctcagagcaggtaacgcagcacgtgcactttgtcgataaaaaacgcaaacgtgaactgttgtcgcagatgattggccagggcaactggcagcaggtgttggtcttcacccgcaccaagcatggcgcgaaccatctggcggaacagcttaataaagacggtattcgcagcgcggcgatccacggtaataaatcgcagggcgcacgtacccgcgcgctggccgattttaaatccggcgatattcgcgtgctggtggcgacggatattgcggcgcgtggtctggatattgaagagctgccgcacgtggtcaactatgaactgccgaacgtgccggaagattatgtacaccgtattggccgtaccggtcgcgcggcggcaactggcgaggcgctgtcgctggtctgtgttgacgagcataaactgttgcgtgatatcgaaaaattgctgaaaaaagagatcccacgcattacgacgccgggctatgagccggacccgtcgattaaagcggagccgattcagaacggtcgtcagcagcgcggcggcggcggcggtcgtggacgcggacaaaatcaggggggagcggggcgcagtcagcagccgcgacgtcaggatagtggggcggcgaaggcgaaaccaaaaccgcgcacaggcgaggggaaaaccgctggcgacaaagcacgtccgccgcgtcgcccgcgcagaatcacgcctgcccagtaaattttatccggcaacatgcccggtagcgcgacgcttaccgggcctacggactatgcaaatacgtaggccggataaggtgcttgcaccgccatccggcaaaatacacatcgcgttgcgagccgccttccagaaccggtaaaaaaggtacttcccgcccctgaaatgtgacacaatagtggctgtttatacagtacttcaggttttctcatggcattgaccgctgcgctgaaagcgcaaatcgccgcctggtataaggcgcttcaggaccagattcccgactttattccccgtgcgccgcagcggcagatgattgctgacgtcgccagaacgctggccggggaagaagggagacatctggctattgaagcgccgaccggcgtcgggaaaaccctctcctatcttattcccggtatcgccattgcccgggaagagcaaaaaacactggtggtcagtaccgctaacgtggcgttacaggatcagatctttagcaaggatttgccgctgctacgaaaaatcatccccgatctgcgctttaccgccgcctttggccgcgggcgttacgtgtgtccgcgaaacctggcggcgctcgccagtagcgagcctacgcagcaggatctgctcgcctttcttgatgatgaactgacgcctaacaaccaggaagagcaaaagcgctgcgccaggctgaaaggggatcttgacggttacaaatgggatggtctgcgggatcataccgacattgctattgacgacgatctgtggcggcgattaagtaccgataaagccagttgtctgaaccgcaactgtcactattaccgcgagtgtccattctttgtcgcccgacgtgaaatacaggaagcggaagtcgtggtggcgaatcacgcgctggtaatggcggcgatggaaagtgaagccgtactgccggaaccaaagcatctgctgttggtactggatgaaggtcatcatctgcccgatgtcgcgcgcgatgcgctggagatgagcgcggaaattaccgcctcctggtatcgcttgcaactggacctgttcagcaaactggtggcgacctgcatggagcaatttcgccctaaaaccacgccgccgttagcgaaccctgagcgacttaacgcccattgcgaggaggtatacgaactgatcgcctcgctcaatgccattcttaatctgtatatgcccgcagcgcaggaggcggagcaccgttttgcaatgggcgagttgcctgatgaggtcatggaaatctgccagcgactggcgaagctgaccgagacgctgcgtgggctggcggaatcctttctcaacgatctcagcgaaaaaaccgggtcgcacgatattgtgcgtttgcatcgggtgattttacagatgaaccgggcgctgggaatgttcgaggcgcaaagtaaattatggcggctggcttcgatggcgcagtcttcaggcgcgccggtgtccaaatgggcgacgcgtgaaatacgcgaagggcaactccacgtctggttccattgtgtcggtatccgcgtcagcgatcagctggaaagattgttatggcgcagcgtaccgcacattattgtcacctcggcgacactgcgctcgctcaatagcttttcgcgcctgcaggaaatgagcggcttaaaagaaaaagccggcgaccgctttgtggcgctggattcgccgtttaatcatgtggaacaggggaaactggtgattcctcaaatgcgctacgaacccaccattgataacgaagagcagcatattgccgaaatggcggcctattttcgtgagcaactggagagcaaaaaacatcatggtatgctggtactgttcgccagcgggcgggcgatgcagcgttttctggagcatgtcgctgatgtgcgcttactcctcctggtccagggcgaccagccgcgttaccggctggtagagctgcaccgtaaacgggtggagagcggcgaacgcagcgtgctggttgggcttcagtcttttgccgaagggctggatcttaaaggcgagctgctgacgcaggtccatatccataaaattgccttcccgccgatcgacagcccggtcgtgatcaccgaaggcgaatggctaaaaagtctgaatcgttatccgtttgaggtacaaagtttaccaagcgcgtcttttaatttaattcagcaggtagggcgattgatccgtagccacgcctgtcggggagaagtggtcatttatgataagcgtttgttgaccaaaaactacggacagcgtttactgaatgccttacctgtttttccgatagagcagcctgccgtgccagacgttatagtaaaaccaaaagcaaaacctgcacgccgccgacggcgttaatgctgtgagcacacttcaaggagctttcaatggattatcgcaagatcatcaaagagatcgggcgaggtaaaaatcacgcccgcgatctggatctggataccgcgcgcggtttgtatacccgaatgctgaatggcgacgtccccgacctggaaatgggcagtatattgatggcgctgcgtattaaaggcgaaggcgaagccgaaatgctgggcttttatgaggccatgcagaatcataccatcaaactgacaccgcccgcagataggccgttgccggtcgttattcccagctataacggcgcgcgtaaacaggcgaatttaacgccgttgctggctatcctgctgcataaattgggcttcccagtcgtagtacacggcgtcagtgaagatccgacccgcgtactgacggaaactatatttgagctgatggggattatccccaccctacacggtggacaagcgcaggccaaactggacgggcgccagccggtgtttatcccggtgagcgcgctctgcccgccgctggaaaaacagctggcgatgcgctggcggatgggcgtgcgtaacagcgcgcattcactggccaagctggcgacgccatttgctgaggatgccgcgctgcgtttatcaagcgtttctcatcctgaatatgttccgcgtgtggcgaccttttttagccgcattggcgggcgggctttgctgatgcatggtaccgaaggcgaagtctatgccaacccgcaacgctgtccgcaaatcagcctgattgatagccgcggcgtgcaggtactgcatgagcgccagagcgacacgtacgacgagccgctttcactgcctgcgactaaagatcctgaaatcaccgcgcgctggattgagcgctgccttgccggccacgagccggtgccgcaatcattaaaaacgcaaatggcctgttgtctggttgcgacgggagaggcggcgacgttagaagacgggcttgcgcgcgtcgaacaggcttttagcgaataaaaaaagcccgtccagtgacggacgggcaaataagggtaacaaacagggttaatgagggttggagcagtgggtctgttggcaaacagacgagggtaatacccgtcagaattcaaacaacagcgatgttacagcctgaaatctggcgggcaggtaaattatttataaatcaccgcagtgccgctcattttgtcattacctacggcggaggtgatgttataagcgcttgcgccagcagcggcggctttttcagccagtttagcttccaggccatccagcgtggtggcgccatcggcagacactacgccgattttatgcaggttttgcgtctgagacgcgctaaccggttctgcggcaaaagcgccaaaagaaagggtggaaagcgcgatggctgcaacagcatatttaatggttttcatgattaatctctcgcaggttattctgtttatgggacgatgttccgtcgatgtgatgagtatcacggttttttgcgaaagataaaatcgaatagaattgactgccttgctcaaaatttttgaatgacaaataacctattgattattaattaattcaacggttgaatttacctttcttgtcatctggctttacagagtcgaggttaacggcacattctgcgacgcagaacgctaaaaagcatgagcgtaaaggaatggataatactggcggtttcggtaaagaaaagtcagcgtaactggctgtcttttgaacctctacgattatatcctgaaaatgttgcgttatgtaaatctttctcctgttggcaggctatgcataaccgaacgcccggcacggctttacgccgcgcttcagggataggatcgccgcaagattcgcattcatcgcgactttcgccgtggggaagttcgccgcgagcgcgggcaacggcatcttcaatggtattgttgatttgttcattcactgcgtcgtcatttgcccagccggatgccatcacgctctcctgattttagggtacctgaggttaagtgtagcgccgtcaggcgaaaaaatcgcatcgcgcggccttttcagaccatgagcagagccaatgtcattcagagagccgatcaaacgagcgaggcagggaattcgcggtggtatatttaccccgtggcgttatacgggtatcttacgccgctgctaaaaggagaatgccatgtccgcccagaaaccggggttacacccgcgcaaccgccatcaacaccgttatgatctcgccgcactgtgtcagaccacgccggaattgacgtcctttcttatccgcacgcccgccggtgaacagagcgttgattttgctaatccgcaagcggtaaaagcgctcaataaggcattgctggcgcatttttatgccgtcacacactgggacattccgccagggtttttatgtccgccggtgcctggtcgtgcggattatatccatcatctggcggatctgcttggcgaaacgacagggagtattccggcgcaggcaactattctggacgtgggcgtgggcgccaattgtatttatccgcttatcggcgtccatgaatatggctggcgatttaccggtagtgaagtcagcgacgcagcgatgtccagcgcgcaggctatcattcaggctaatacggggttaagccgcgccattcgtctgcgtcggcaaaaagatccggcggccatttttaccggtatcattcataaaaatgaattttatgacgcaacgctttgtaacccgccttttcacgactccgccgccgcagcccgcgcgggcagcgagcgtaagcgccgcaatttggggcagaataaagatgatgcgctgaactttggcggtcaacagcaggagctatggtgcgaaggcggcgaagtcgcctttattaaaaaaatgattgctgaaagccaatccttccgccgtcaggtgttgtggtttacgacgttggtgtcgcgcggcgagaatttaccgccgctttaccgggcgttgacggaggctggcgcggtgaaagtggtgaaaaaagagatggcccaggggcaaaagcaaagccgctttattgcctggacctttatggatgacgaccagcgtcgccgttttatcacccgtaaacgctaaatcgtcggttcgcgcggcggcagcgaatcaggcgacgggccgccgacgggggcgggcagaacctgatacgtttgcaccggcgcgcgcacattagccagatcaaaatgctttttcacctggctatcaagggcaaaacgcaccgtccactgcttgagcggtagcgtggtgaacgacacgcgtaaagtaaacgccgtgttcgttaaactgacaataccggcgaacgtgggttcgccgataatcagcccgcgaatatcctccgtctccatcagcgccgttaccgcgtctttcagcgcctgattcgctttatccgcatcctcatggcgatccacgtcatagttggcgacaacagagccgataccgcgcacaaagttggcgaaagtggtgatcgaggaccacgggataatatggtatgccccggtatcctgccgcacgccgacggaacgaatcgacattctttcgaccgtccccgtcagcgggcctatggtgactaagtcgccggtattcatcccgttttcaaactgaataaagacgccggtgataatatctttcaccagggtttgcgaaccgaaagagatagccagacctaacgcgcccgcgccagccagcaatggcgcgatattgacgccgatttccgataacacgatcatgatggttatggtactgataatcactgccagcgcattgcggaacagcgtcagcagcgtgcgcgtgcgggcgctgggtagcgggcggccatgaatatcggaggccagacgattctcaatcagactggcgaggatcgtccatcccacggcggagaagaataagattaacgcgatacggataaggatatcgaccatcttttcccccgcgccataatgtagccagtgccagaaatcgaatagcccccaggcgttgagcaacagcataacggcgacgcagacggtcaaaaagcgtgcgacttttagcgccgaggagagccagccgttaagccgcttttgtaattccgggtaattgcgctgcgtatggggcgacagggtgatggttttcgctatccagcgggtaaacataccggagataaacgccgcgatgccaataatcgccagactgcgcacggtcgcgcccatcataaacttcaggctattgcctgggtcgaataacgagaagaaaaacagcacgataaagtaagcgctggccagccagtgccacaccagcgcaaaggcgcggataaacaggctaaaaaaggctaatgatcgttccgccagacttaataaatgttgcgtaatctccgctttgtttttaaagatcaggtacagcgcccagatggtgatgcagagcatgatcgccacattagccatcgcgccaacctgaacattcacctggttggaaataatcggaacggcaacaattagcccgtagccaatcaaactgctaagggaactcatacggcgattccagtaacgcgctgtcgcatcctgaatcgcgaatgggcgtaattccggtacattagggcaaaaaataagccgcagaatcgctttaaagaactctattagcgcgaaggcattcaggaacaggctttgctgaaaagcgatagttcgacttcccgcatggaaattatcactgagcatctgaccgataaataaggtgagcgccagtagcaggaggtcgataataaacgcgccgacgatcatcgccgggagctgtaaccagttgctgcgttcacggtttttcttgcgtgcccacaggcccatttttcgatataacggcagggcgcaaagccgtatcacgctataaaaaccaaataccgcgacggccagaaataaaaagtgggttaacgcgttggtgaaggtttgcgagttaaacggcttgtgcggcgcatcggtgatgttgcgataaagctgggcgaaacgggtagcgaaagcatcgccgtactgacgggtaacggtggtgacgttctccagtaccgttttctcatctttggccgcaggcggcgcaagcgctggcgctggctcggtcggcggcgtggttgaggcttcgcggagttgcgctatcaattcgttacgtgaagcctcgttctccagtacgtcagccagggccgcataggccgcttttttttgttcaggactgggctctggcgctgcttgctggctggttgatgtccccgtggtcacgccgggtatggcgaccgcatgggcaggtgcgcccagtagacaaaaaaggatgaacagggtccaccgcatgactcctccagtgagaaaagagacgcaaaacactaagtatagatggcgcaggggagggaaaatgaaatgggactattccatgatgcccttcctgccgcagggctggaagggcgatatctcaggagacgtgctgtaaaaattcctgtaaacgtgggcttggcgggttttcgatcaacgcctgcggactgccatcttcggcaatacggcctttatcgataaaaatcagccgtgaggcgactttttcggcaaagccgatttcgtgagtgacaatgaccatggtcatgccttcttccgccagatcctgcatgactttcagcacttcatggcgcagttcagggtccagagcggaggttggctcgtcaaagagcatcattttcggcttcacggccagcgctcgggcaatggcgacgcgctgttgttgaccgccggaaagctcggaggggtagtggtgcgcccgttccgccagtccaactttcgctaacagagctttcgcctgtttttccgcttcttctttctttacgccgcgcacgcgcagaggaccgaacatcacgttttcgagcgcggtcagatgcgggaacagataaaactgttgaaacaccatgccggcttcctggcgaatcagccgttcgtctactttaggatcgttgactttcagaccatcgacaatcagatcgccggaggtgatctcttccagtttattgatacagcgtaataacgtggatttacccgaaccggaagggccgataatcacaaccacttcgccctgacggatgtttaaatcaatgttatgtagcacctgggtggggccaaagtgcttggagacgtttttaaattcaatcacaggattttcatccttctttcaagacgacgcaaaataaagctcagcaccagcgtaatgatcaaatagaagacggccacggcgctccagatttccagggcgcgaaagttaccggcaataatttcctggccctgacgggtcagctcggctacgccgataacaataaacaacgaggtgtctttgatgctaatgatccactgattgcccagcggcggcagcatacggcgcagagcaagcggtaaaataacatggcggatggtttcccggcgagaaaggcccagcgccagacccgcttcgcgaaaacctttgtgaatggatagtactgcgccgcgagtaatttccgcgatataagcgccggagttaatcataattgtcacgaccgctgcgctgaacggatcaatacgcaaatcattaaatgccatcggcagggcaaagtagataaacatgacctggacaacgatgggcgtgccgcgaataatttcaatgaaaaccagggcgatgtggttggcgaaccagccgccaaacgtacgggcaaaacctgccgccagtccaataaccaggccgccagccagaccgaggaccgagatccacagggtcattttagcgccctcaagcaaaagcggaatggcgggccagatggcgctccagtcaaactgcatatgtcgttcctgttaccgtggtgtaaatagtcaaatgctctatccggcgcggaaatggcggaaagtgtcttatccgtcacggaaagagctgtaggcccggtgagcgtcctcactaccgggccacaagccaacatcaggtcgttttatttaggttctgtaccgaaccattttttgtagatttcgttataggtgccattctcacgcagcgttttcagcgcgccgttgactttctcgcgcagttcatcgctgcctttcgggaaggcaactccgtattgctgtgcttccagcgattcgcctaccgccttgaactggccgttgcctgcggttttgataaagtacaggatgttcggcgtatcgtgcagaacggcgtctgcgcggttggtgcctaattccatgtacgcgttatcaatgttcgggaactgacgcaggtctttggttttgatattcgctttcgcgtaatccaccgacccggttccgctcttcacggcaacgactttgccatcgaggtctttaacgcttttaatatcgttattgttggctttcaccatcacgagcagaccgcttttgtaatagccatcggaaaagtcgatcgcttttttacgctcgtccgtaatcgtaatacccgccagcgccagatcgatatttttggtttgtaatgccggaataatgccgctgaaatccatcggtttcagggtgtagtccagcttcagttctttcgcgatagcgtcccacagatcaacatcaaaaccgacgtatttgtcgccctgtttaaattcaaacggaacgaacgccgtatcggttgccacaacgagtttcttatccgcagcgtgcgaagacaccgcaaaagccagggtaagtgcagccagtgaaacttttaatagagacttcatagcatttccttttctatccacggggcgatcccctgcgagaacatgtagcgtaatgaaaaaatcatgccaattatgtaactcattgttttaacagaagcgtgaaacattcctgtgcacaataagtcgggcaaaaccagtatgccgcaccgttttggggcactgatttagtgcatgaataacaaagtagagatacagggtctatttagcgtaaaaatcgttgttaaaacaatctttaattaacgattgtgtgatgtaattattacaaataattcacttttgtcggaggggagtacaagacgtgtgcactatttaagtgcaaaacccctgtgccaggcaggggtatagggatgacttatatacctgtgtacatcaagttgcaggtgcgttcgcttcagtgaccgacggaagtcaggcttctgcggattcgctgcgtttgtaccttcctgcaactcgaagtattcagggtagagatagatttattcgatgttggattcgataaaccacaggaatttatcgaggtcgcgtgatgcggcggtaaagatatcggcagtgtcttcatctttggcttcaccaatagctttgcgaacatcattagcgacaacagcgtagcgatcggccagttcttttaagtgatcctgcacgttatggatgtcgagcggatagcttttcagtggagttttgctgttgataacttgcgtggtgcctaacgccacaccgccaagctgtacggcgcgctcggccatagtatccagatgatcggtcagtgcggtacggaagccatccagcatctcatgaacggcaataaagttagcaccgcgcatgttccagtgggcctgtttcgtgatcagcgacaggtcaatgaactggatcacctgacgattaagcaactcaaccgtcgcttttttatcgctctctgatacatcgttacgggtataaagcagattagacgcttttgtttttaccagtttagcggtactcataatctcatatcctcttgatgtttgtgtcccaggtaattaacgaaaataagtatagcaccggtttttaactttgcttttttgaatttacctatcactttaatagtacagacaagatttaatatttattttgattaaaaatcaattggttagacgagtttgctgtttggtgggtaataattctcattttaatgtaaaaaatgagaaaaaatatgacaaaaaatgacgaagtaatagcgcaataataaaaggtgaataacgaggtgatattctgcatgattatgcacatcatgcagaataagaaactattttacgtcaacttgtttaatttgcggttcgcgtcgaatcgttagggtagaacccattgaggcggcaatgatggcgcacagggccaggatttgtatgcccgtaagcgtttcgcccagaaaaatcatcccggaaacggcggccagcgcgggttccatgctcatcagcgtaccgaaggtgcgggttggcaggcgcgtcagcgcaatcatttccagtgaataaggcagcgccgtagaaagcacagcgaccgctaaccctaagggaagaatcgaccagtgccatagcgcgtcgccagcctgaactgcgccaatcggcacgaaaatgatggcggcaatcagcgagcctaccgccaccgtggccggaccatgttccgcgcctgctcgctggccggtaagaatatagacagcccaacaggcgccagcgccgagcgccaacgcggccccggtaagatcgacgtgagacatatcttgtcctaatggcagcaggaaccagagcccaagcacagccagtacgacccaaataaaatctaccggccgccgggatgaaaacagcgcgaccgccagaggaccggtaaattccagcgcgaccgcaatacccaacggcaccgtctgaatcgacagatagaatagatagttcatcccgcccagcgacagaccataaaacaataaaggcagccgctgctctttggcaaaacgcaaacgccagggtttgaaaaaggcgataaggataagcgttcccaacgccagacgaagcgccgttacgcccggcgcgccgacaagaggaaataacgatttcgccagtgaagcgccactctgaatagaggacatggcaatgagcaaaaccaaaatgggcaaccagactggtagtttacgtgttgaccccggcatcctttctcctgtcaaaaaatgtcagtacgagtaaaggtggcagtgtaatggaaattccccgcggcggttgagggttcgttgaaaaaaaatttccaggattccataaaatgaacttaaattgatggataaatagactgttagtttaggaataatctggatgaatgtatcgcgccgcacgcgcattattggtgcaataagccggaaaagtgatgttaattgaataagatagcgcgatatggaaacgttctgttacatgaaaggcgcccttagacaccgtgaatcgcaaagagtttcccattaatttttgatatatttaaaacttaggacttacttgaagcacatttgaggtggttatgaaaaaaattgcatgtctttcagcactggccgctgttctggctttttccgcaggtactgcagtagctgctacttctaccgttaccggtggttacgctcagagcgacgcgcagggcgtagcgaataaaatgagcggtttcaacctgaagtatcgttacgagcaggacgacaacccgctgggcgtaatcggttccttcacctacaccgaaaaagatcgtactaacggtgcgggcgattacaacaaaggtcagtactacggcatcactgccggcccggcttaccgtctgaacgattgggcaagcatctacggtgtagtcggtgtgggttacggtaaattccagacgaccgattacccaacctacaaacatgacaccagcgattatggcttctcctatggcgctggtctgcaattcaacccgatggaaaatgttgctctggacttctcttacgagcagagccgtattcgtagcgttgacgttggcacctggattgctggcgtaggttaccgcttctaatcacgtcggtgaaaatgaaaaatccgcctttcggggcggattttttttgcctgaaacgtgcattattttagtgaaaaaatatcgctgcccagatggttatagtccactttctgtaatttgaaattggtgatataaacgggcccggctttctgttccgaaataaatcgatagcgatttttgatctctttagcgctaattcctgtccattgcgagaaaaaactcaggaaatcgttcgcggaacggcgagctttaatgatccgatgcgctttactgtcgctggatagcaccataaacggcacctggaagttttgctggaatttgtcgtcatgcgccaggtactgtaccgctttgccgcgctctttaaacgccagcccgtgatcggagaaatagacgagcgaaaaactgtcgccgctatgacgaagctgagtatagagctgacggagcaaatcgtcggtttgcgtcatggtgtataaataacaagacgtctctttcgactggacaaacgtcgcgtattttccctgagtacggtcgcaggcctggggatgcgaccccattaaatgcaacacaatcaactgcggttgcgtgcgttctgtcgccaatacctgcgccgtcatggttaacagcgcttcgtcgcgagtatttttatccgcttcaaaatcgccgtttttcaggaaatgcgcttcatcggcgcgtttggcgatactggcgatggccgtgtcgtattcgccgatttgcccctgattggaaaaccaccatgtctgaaaaccggcgcggttagccagcgtgacgaaattatcctgatactgtggtttgttatccaccacgcgattgagcgttaaaccgagcgatttttgcgttgagccgctggcggcgatgtaatccataaagaagtcgccattcacatggctggcgaagggggtattatcccagtggccgccgaaagcgcccatggcatcccgtcgcgcgctttcaccaatcaccacgacatagatgtgatatctgggtttcaccgcagtaaccgtccagctatcttttatgccggatagctgcgccatacggtgctgctcttcaatgacttcgttgttattgacgataacgtctttggcgaagcgaaaaaccggatagccggtatcaataaccttaaaaacgccgccccacgccagattttgtaccggcgcgacgaaaaatgccgcgacgctaatcagcaggcacaggctgtcgaggctattccagcgcggcctggcctcttcttttcggcggcgaagcgcaataatacccagcgcaaaaataaaaagtccggtcaggtagctataccacgggaagatggtcaggatttcgctcgactcttccatattggtggagtgcagcgccagcagcgtattaaagttcggcgcgccgtaagcctggccaaagggaaaatagcaagcggctaccagcgaacagatgccgagcagcgctttttgtccgcggggcaggtagcgccagagcaacagcaacaggcaggtaaacgccgcggtataaagcaggctaaaggggtagccgagcgcgaggttaatcagcagcgactgtaaaaagtagaggcccgcccacgggcttacagcccgacgacgggccagaagtgaatcgataagggttgaattcatatgccactattgcaaaaacgccatgtgctaaccctggcgcgaagggtcattacctgcctgattatgcgtaaaaaaggtattgggttcgcaacggcgagtcgcaaaatattcagggctgccagaagatagagcgtgcgggtaagaaggtcaaccgccggaaagaaaatgttttgcgaagagaatagcaaaaccacaaaaaaacaggggaaatgggcgccatttccgttgaggatgcaaaataaagcggcgtaccgcaccgccgcgttatttcgtggaagggttatcctgctccggtttgccgttgatcatatcgcacaacatagagagcagcattaaccggactttaaagggagagtgactgaacacgcgtatacacctcttaaattcgttcatataaacctcctgatgtttctatcccatcgatccgtgagggatgtctgcattacatacagatatagcacaggctatgttttatagctattgctaaaacgttaattttttgtgcccagacaactctggtttacaatgagcgctctgtcagctgacgcgttaacgcgtcacagaaacgaggaagcaaaatgggtcgtcgcgcaggtacgccaacaacaaaaaaagtgacgcaattggtgaacgtagaagaacacgttgaaggatttcgtcaggtcagagaggcgcatcgccgtgagttgatagacgactacgttgagctgatttccgatttaattattgaggtaggggaagcgcgtcaggtggatatggcggcgcggctcggcgtctcccagccgactgtggccaaaatgcttaagcgcctggcatcgttaggatttattcaaatgatcccctggcgcggcgtttttctgacgccggaaggggagaagctggcgcaggaaagccgcgagcggcaccaaattgtcgaaaattttttactggtattaggcgtaagtccggagatcgcgcgtcgtgatgcggaagggatggaacaccatgtcagccaggagacattggatgcctttttggccttcacgcaacagcatggaacatctgcagaatgagtctggcctttttacgggcgctgcggcgtgaccgtttttttcagttgttgatcattgtggggatggcgttaagcctgtttgttccttttgcgccccgcgcctggcctggcgcgattgactggcacaccattattaccctcagtgggttaatgttgctcactaaaggcgttgagctgagcggctattttgatgtgctgggacgcaagatgacgcgccgatttcataccgagcggcaactggcgatgttcctggtgctggctgcggcggcgctgtcgacctttctgacaaacgatgtcgcgctgtttatcgttgtgccgctgacgataacgttaaaaaaactgtgcgcgattccggtcaaccgattgattatttttgaagcgttggcggtgaacgccggttcgctgctgacgcctgtcggtaatccgcaaaatattctgttgtggggacgctccggcttaacctttgctgaatttagcgggcaaatggcgccgcttgccgtcatgatgatgctgacgttactgctcctgtgctggttttgttttccgggtagggcgttacagtatcataccggtacgcgttcgccgcagtggcagccccgtctggtgtggagttgcctggcattatatgtcgtttttcttaccgcgctggagctcaggcaagagttatggggactggtgttggtggcggctgggtttattgtgctggcgcgcagggtgatagtcagcgtggactggacgctgctgctggtatttatggcgatgtttattgatgtccatctgctaacgcaattgccggcgttgcagggcgttttcaaccaggttggcgcactgtctcacctggggctttggctaaccgctatcggcctgtcgcagattatcagtaatgtgcccagtaccattctcctgctgaactatgtaccggcctcgacgctgctggcgtgggcggtgaatatcggcgggtttggtctgctgccggggtcgctggcaaatcttattgctttacggatggcgaacgatcgccgaatctggtggcgatttcatttctattcgctgccgatgctggcatgggcggcgctggtgggatatggattattgcaactgatgccgtaagagaagcccgatagtatctatcgggcttcgcaggcagagtctgtcagttcagacgaaccggcatcccggaacgatcctgaactgcctgttgtacgacggtctgatcaacgtcaggctcgttggtgacggccaggatactcttattaagcgtgatcggcaccgcttccttaccttcaaactgcgcttccgtcgttgacagcgggttatgcacctcaatgtaacggctaccgtccggctcggtggtggcttttaccggttcatcgataaactgcacgcgggtaccgaccggcacattttcaaacaggaatttgatatcgtcgttgcgcagacgtacgcagccgtggctcacgcgaagcccgatgccgaagttggcgttggtgccgtgaatagcatacaggcgaccgatgtacagcgcgtacaggcccatcgggttatccgggcccgcaggcacgacggcaggcagcggctcgccggcggcgcgatattcagcgtgcatttttgccgtaggcgtccaggtcggaccggcttttttacgttcaactttggtcgtccagttgataggcgtgtctttacctaactgaccgatcccaatcggcaggacgataacggtgtttgtgcctttcgggtagtaatagaggcgcatttccgcgctattgatgataatgccttcgtgtacggtatccggcaggatcagctgctgcggaatattcagcacggtaccgcccttcggcaggaaggtatccacgccagggttggcttccagcatgttggagagccccatctggtactccgcggcaaaatactccagcggctgggtattgccctccggaacggtgatgacctgattttgcccaattaaacggctaccatcggtaggcagcgggtaagtgactgctgaggctgttttacaaaaaccaactacagcgaaagccgccgcgaaaagcgttgttaatttcatattcatgttatgcgagattctgtgccaagcaggctagtaggttgagaattctgtcatgttgggagcgcattataggtgcattccagtaaacagggaattcagatgtgtacgaaatcacgtttttttcccttacggttcagtgtagccctttgtacagggcgcgatcttatttcagacttgtggcataataagcggtttgtcacatcttttttcaggataagcctgtgttagtttccagcaacgttaccatgcagttcggcagtaagccgctgttcgaaaacatttccgtcaaatttggcggcggcaaccgttacggcctgatcggcgccaacggtagcggaaagtccacttttatgaaaatcctcggcggcgacctggagccgacgctgggcaatgtttccctcgatccgaatgagcgcatcggtaagctgcgtcaggaccagttcgcttttgaaacattcaccgtacttgatactgtcattatggggcatggcgaactgtgggaagtcaagcaggagcgcgaccgtatctacgccttgccggaaatgagcgaagaagacggctataaagtcgccgatctggaagtaaaatacggcgagatggacggttattccgctgaggcgcgcgcgggcgaactgctgttgggggtgggcatcccgctggagcagcattacggtctgatgagtgaagtcgcgccaggctggaaattacgtgtgctgctggcgcaggcgttattctctaatccggacatcctgttgctcgacgaaccgaccaacaacctggatattgatactatccgttggctggagcaggtgctgaacgagcgcgacagcacgatgatcatcatttcgcacgaccgtcacttcctgaacatggtttgtacgcatatggcggatctggattatggcgacttgcgcgtctatccgggtaactatgatgagtatatgacggcggcgacccaggcgcgtgaacgtctgttggccgataatgcgaagaaaaaagcgcaaattgccgagctgcaatcttttgttagccgttttagcgccaatgcctctaaatcgcgtcaggcaacgtcgcgcgcgcggcagattgataaaatcaagctggaagaggtgaaagcctccagccgtcagaacccgttcatccgttttgagcaggataaaaaactgttccgtaacgctctggaagtggaggcgctgacgaaaggttttgataacggtccgctgtttaaaaatgtcaatttgctgctcgaagtcggcgagaagctggcggtactcggcaccaatggcgtgggtaaatctacgctgctgaagacgctggttggcgatctggacgccgatcacggcaccgttaaatggtcggaaaacgcgcgtattggttactacgcgcaggaccacgaatatgaattcgaaaatgacctgacggtgtttgaatggatgagtcagtggaaacaggaaggcgacgacgagcaggcagtgcgcagtattctgggccgcctgctatttagccaggatgatatcaaaaagcctgccaaagtcctctccggtggcgagaagggccgtatgctgttcggcaaactgatgatgcaaaagccgaatatcctgatcatggacgaaccgactaaccacctggatatggagtcgatcgaatcgctgaatatggcgctggaactgtatcagggcacgctgatctttgtttcgcacgaccgtgagttcgtcagctcgctggcaacccgcgtcattgaaattacgccggagcgcgtggtggacttcagcggcaactacgacgattatttgcgtagtaaagggatcgagtaagttattgtctgtaaccccgatagcgtcggggttacagaatgttaacaaggtaatttttattttttccgaatgcaatgtgaaaattatatatactcttagagcctatcccattagggctattttacttgccattttggacctgggcagtgctcgccaaaacgcgttagcgttttgaacgccgctagcggcggcccgaagggcgagcgtagcgagtcaaacctcacgtactacgtgtacgctccggtttttgcgcgctgtccgtgtccaaactggctgcgccaataacgcctggtgggataggctcttaatattctattttaaaattaaatgaaagaagaggatctatcataaaaattgcgaatatattttgtggtaaacatattgtaatgttattttctttataagaattcaagtgctattttatattcctttattgttcaacaaaaggaataaatatgagcattttggaacgcttttttggccgtaaagaaaaaaactcatctaatatacaaggtgttttagtagcgaatgctgaagttgataacccactaagtttagttgttgtatttgatactctcccggaaaataattcaaaagaactcacccgcttgttgcgtaattatcattccagtatgaaacaggcaacgtgtgaacttgtccctgaactggatttttttggtttagcaggatggggtaagcatgtaatatcgatggttggatttaaaacgccttaccctcaggaatcaatcgaacaatgcgtcgcgccagctcattatccccaggaagtaaaagagcaagtacgggcaaccagtgcaaatattattttatattataaggggtatgatacttcacctttagagcaatatgttgcgttggctgtggttgcaggtgcattaagtaacatgggggctgtcgctgtattaaatgaatcggctcacacttcattacctgcgggggtatttaagtctcaggagttgggtaagcatagtctggaaatgttgcgtgaaggtttcccgctgacctctctattttgtggatttgtgaaatatgaagttgaggatatcgaaggcgtatggatgcgtacctatggtgctgattgctttgggctaccagatttcgcagcacacgcacaaggtcatcacgaagggcaaaaatattctgatattttcaataatgttctgcgttacctgcttgaaagtggagcagaaatggctgccgggcataccatgcaagtcggtaaaacgacatttatgaaactgcgcgatccccttgacgatgaatattacttacaggggcctggaaccacattagtggttgaactgattgaagaagatgagtgtaatgctcattgagaaatcggggtaattgccccgactctcgttaaagtgtaaacggcactttattttccagcaccgcctgaatcacattcagtgcgccttcatgcttattattatcggtagcgtaacgggcgatttgtttaatgttttctgcggcattgtccatcgcaaaggaataatgcgccatttttagcatctctgcgtcattgccgctgtcgccaatcgctaccatattttgtggcggcagatcccagcgtttcagtaaccgcgaaataccgtttgctttatgcaggccgggaataatcagatcgataaaaccgaagccgctggtgacgggcttcataatgccatcgagcgtaacgtgtagtttgtcgatcactaacgggatttgttcatccggtaggttgagcgaaaacttgaacagtacgtcatcaatctcctgataatcttttacgggtttcaggcgatggtagtgttttgccatcagggtaacgaatgcttctggcgcattttcgctgacatatgcactttgcagaccgcaggcgacaaaattaagttgcttatctttcagcaactcgccaataataatccgcgattcatgtcgggtcagttcgccgtggaacagttgcttgccatgttcgtaaaccagtgcgccgttttccgcgacaaaagagatcgcatcctttagctcaggaaagaacgaaataagctggtaatactgattaccgctggcgacaacgaactcaatgccgcgctttttcagttcctgaaattacgccggagcgcgtggtggacttcagcggcaactacgacgattatttgcgtagtaaagggattgaaagctaaacactgacgcccggtggcgttgtgtttaccgggcctacgtatcctggcgcgtaggtccggtaagacgggtgcgcccagacaaagggcgcaccgcagttaagcgggcagggcggtacgaccgtcaaacatctatacctaatgcccgtttaccgtgaatattcagatcgcgcagcgtgaagcgcccttcccaggtggtttcatagtcctcgcgcgggaaatcgcccggtgatgcgcctgtctccagcgccgctttcaccttacgcgcataggccagatttttctcacacattggcgcggcaggaatgtacatcacattgccccagccctgctgattttcgacgggggcgacggagtggatgacatcgcaatgccaccacacggaatccccggcttccagcggcggaatgctggttaacgccgccatcagtaaaggatgccactgttcagaaatcggcagcacccggcccggcgcgacgccgcataattcatcttccgggacatcatccagcagcgggcgcagcagaatatacgccatcgcctccgggatagggacgacatgaagcaacccctgaccgggcagcatatcggagagcgcggtccagccctggaaggtgcgaaataccgagcattttgtggtgttatccaccgtgtactcttcaacgtcggtacggtgcgccgcattccacggatcgtactgctcgacgttgccgttaaacacgctggcgaatacctgctgataggctggcagcagccagcgttccagcgcgccggagtcggtatgcgcccccagtcctttggatgtggtgcccggcgggcggcggcggatgcgatccgggtaaataatgctgatatccggattaaaccatcgcttgccgtcgtgctctacctgccatagacggttgaggaacgactgcgccagcgccatctcttcactttggcgggcctgcatttgcgcctgcgaccagtagacaggatagatttcaggccgggaggcgctcagcgtaccgaaaaaattatcccccggtcctttatacacctcgtcaaaatggttcttgtccagataatcgagcatcgactggtcccatgccagcgcctgttcgcgtggaaaatgacctttaatcaccgcgcacccgcggcgcttaacctcggcgcgggtggcatcgctaatgttgcccatcgccagttcgctaaaagggataattggccataccggctgcccctgcgccttcagatcgttaatttccgccacccgggctgctatggtggcgctcaaacggtcgaacaccgcctgtacgtcgccgatttgcgcgcgtagcgcctgcttcatctgacgaatggccgcttttgggtcggcgggcagcgtttcgtgggtaaaaggagtcgtcatatcaacctcatcatctttcgttcgaaagtaaaattagttacatctgatactttaagttaaaataaggttaatgcaagtttaaaatattgcaggagcgcacaaggagagaagcgagaggaaaacgtaaggtggccaggacgccttaatgtcttatgcggctattcctttcgttcagccacttttcattcgaaataaatttgtggttctgctcacattgttattaaaatgtttctggtcgcagttacagccaggagcttaagtatgaccgttaacgttgtcgttacagatatggacggcacttttctcgacgatgccaagcagtacgatcgtgtacgcttcatggcgcaataccaggaactgaaaaaacgtaatatcgaatttgtggtcgccagcggtaatcagtactatcagttgatctccttcttccccgagctgaaagacgaaatttcctttgtcgcagaaaatggcgcgctggtgtatgaacatggcaagcagttgtttcacggggagctaacccggcatgaatcgcggattgtgattggcgaactgctgaaggataagcagcttaacttcgtcgcctgcggtctgaaaagcgcttatgtcagcaaaaacgctcccgagactttcgtggcgctgatggccaaacattatcaccgcctgcagccggtaaacgattatcacgacattgacgatatcctgtttaagttctccctgaatttgcccgatgaacaaattccgctggttatcgacaaactgcacgtatctctggatggcatcatgaagcccgtcaccagcggcttcggttttatcgacctgattatcccgggactgcataaagcgaatggcatcagtcgtctgttaaagcgctggaacaggtcgccacagaatgtcgtcgccattggcgacagcggtaatgatgcggaaatgttgaaaatggcgcattactcttttgccatgggcaatgccgcagacaatatcaaagcgctttcacgttatcacactgatgataataaccatcaaggcgcgctcaacgtcattcaggccgtgcttgacggcaccgatcccttctgattaacaggcctgcgtaggcctgttaaacgtagcgccatcaggcagttcggacatattgccgatggcgccagggtaaattacagcatatgttcggtacgggcgatgatatcgtcctgcgcatccggcgacagcgcggtgaagaaggcggagtagcctgccacacgcacgaccagatcgcggtactggtctggatgttttttcgcatccaacagcgtttcgcgtgacacgatgttgtactgaatatgccagcctttatgcacctcaaagaacgtccgtagcagaaccatcagtttctgtttgtcggattcgttttccagcgtcgttgggttcagtttctggttgagcagcacgccgccgagaatggaaccggtaggtaatttgcctacggaaccaatcaccgccgtcgggccgagatgatccgtacctgatgcagggcttgcgccttccgccagcggtgtatgcgctttgcgaccatccggggtagccatagtcgcggcgccaaatggcacgtttgctgagatagaggacgtaccggcgtaatagttgccgccgacagggccacgaccgtagcgcgggttatgatattgcttcagctcatcaatataggtctgataagcgcgcgccagcagcgtatcgacggtatcatcgtcgttaccgtacttcggcgcgccgttaatcagacgctggcgcagctgctcatgggtcagcccgtcaaagtcatcggccagcgcggcggcaagctgctgttgaccgataacgccctgttcgaagaccagttttttcacagcggcgaggctgttgcccaggttggcgataccgacctggagaccggatacccagtcatatttcgcgccgccttgcttgatacttttcgctcgctcaatacagtcatctaccagcgctgagcagaggatatcgtggacgttctcttccaacatggtgtcgaccacatactcaatttcaatcgatttgcgcgtgtagtagcgaatttgggtatcccaggcggccatcacttcgtcaaaattgttaaagttgcctgcggagagcgccttttcctgcggcagaaataccttgccgctggtggcgtcgcgaccgccttccagcgccgccagcatgacgcgggcgaagttaataaagctcatgccggtgcagcgataaccccatttcccgccgacggcggtttcgatacagccgatcgccgcataatcgtaagcgtcctgcggttcgatccccaacttgataaattccgggatgacgatttcatcattgttaaacgccggcatcccaaagccgcagcggatgacctggacgcaggcgtcaaggaaatcgttactcattccggcgtgataacgcacactgaggttgggctgggtagaacgcagacgtccacaggactccagaatggcgtaagacagcggattcactgcatccattggctgaccgttgataagtttctgaccgccaatggtgacgttttgatacagcgggctgcccgcggaggctttagagtgcgaaccggagcggatcttgtttacttccagcagtttcagccagcagctgtgcagcagttcaatggcgtgctcacgatccagcgtctggtttagttcgacatcgcgacgataataggggtaaagatactggtccatacgaccaaatgacaccgagtgaccgttagactcaatttgtagaatcagttggatgaagtagcacaattgcagtgcttgccagaaggtctgcggcggttggtgggcgatcacctcgcagttttcggcgatggtaagtagctctttacgacggctttcacgggactcttcgcccgccatctggcgcgccagcgcggcaaagcgcgtgatatgctggcttaccgcgtccagcacaatatcaatcgccttcaggaactgctcgccatgcagatcttccagcacggtcaggttgatgcgtgagcggcgctcggcgactttatcgcgcaggccataaagccctttttccagcagcagcgggaagttcaccgccaggtgcgcatcgccggaagtcatattgccttcggctttgataatgccagtcgccagaagccctttttgttcatcggtaaacatgccgtagcagcgatcctggacggtttgaccgcgccaccacggacagacgtcgtgcagaatacgtttgttttcttcacttacggaaaaacctgcgccgggccggtccgccaggtcgtcgatctctttttcaatccacgagacggtatattccgggaaaatcggcgcggcgcggacttcacttgcctggttgccgacgatcagttcatcgtgttttatccagatagtgcgttccgccaggtgatgggccagcgccagcgcacggcgtaccggaatcggtttatccagatgctgctggtacatttcggtataatgctgcgcgcgctcggtacagaccggcggtttcacgatatgtaccagcgcggttttgtgcgccttaatgcggtcactgagcgtgtccagtttcagttgggtcatgataattatcctcgtagggtcgcggttaaacctttttggcaggcgtacttctgggcaaaatcaagtaacgccggcgcatccagtggtttatccggggcatgatagggttgactgagtaagtggtatttattgatgcccagcgtgtggtagggcagaaaatgaatttccccgacgtgcagttcgtcggcggcaaagtcggtaatggctttaatggcctcctcatcggcattaaatccctgaatcagcgggacgcgaatcaccatttttttgcccgcggcggcgagtttcctgagattttccagcacccgcgaggcgctgccatcggtccactgcttaaacggcccgtcggcgacatgcttcaaatcagccagaaacagatcgatataaggcagtgagggcgcaatgtatttccatgggacatgcagacaggtctcaaccgcagtatgaataccggcgtcatggctggctttaaacagctctgccgccagttccggctgcataaacggttcgccgccggaaagcgtaagaccgccgccgctgcgatcgtaaaaaggtttatcgcgcagtaccgtcgccatgatctcatccacgctttttatttcgccgcacacggttaacgcctgtgtggggcagcaatgcgccaggatggaaaaatgggcgtcggtcagtttctcgcgatggatgagcaggccgtttagcgcgcgctcaatgacgtccggcgcggcttgcgcgcacaggtcgcatccttcgagacacagccgcgcgtcgtataacagatcctgagcgcgggcgcggctttccgggttctggcaccagcgacagcccaacgaacagcctttgagaaatactacggtacggataccggggccatcgtgggtagaatagcgctgaatattgaagatcataaacggcctctcttatttcatataaagattaaattactttcgaatgaaagctatcttgatgtgcgtcaacgaatggagaggttctgacaaagaggcgttaaatgaggtacaacatcacggtttgaggttgtggtatggcgtttaagatgatgccgcgctgcttgagccgatcgtcagtcggagcttgggtaagctggctttgcgtctgatgacagtaattatctgttgatacagcacggccataaaccgtgctttggtatgtttatccgtaaagtggctactgcccgcagacctcacagccggggttgcgcattaacttcatttcgcggaactgacaggtcatcgcatcgtacatgacgatttttccgctggcaggctgaccgtaatgcgccagtagcttaatggcctccattgcctgtagcgaaccgatcacgccaatcagcggcgccatcacccctgcctctacgcaggtcagagcgttttcgccaaacagacggctcaggcagcggtaacagggttcgttttcccgatacgtaaagacggtaacttgtccttccatacgaatggccgcgccggagattagcggcactttcgcggtatagcacccggcgttaagttgattacgtacgctaacgttatcggtacagtccagcaccagcgaatgcccggcaatcaggctggtcatagcgtcgtcgtccagccgcgcgttaacgggcgtaatggtaatatgtgggttgatacgcgccagcgcgtcgcgggcggactctaccttcggctgcccgaccgtggcgtcgctgtgcaaggtttgacgctggagattggaaacggaaacggtatcaaaatcgagtagcgtcagttgcccgacgccagcgccagccagatactgcgttgccgcgcagccgagcccgcccagcccgaccactaatacccgcgcatcttttaacgcttcctgcccttcaaaatcgaagccgcgcagaataatttgtcggttatagcgcagcatctcctggtcgctaagttccgccattacaggcctccgaacagagcattaaacggctcgacttccacccattctcccggctcaacattgccgcgttcacgctccagcacaataaagcagttgcccagactaaacgagctgaaaatatgtgaaccctggtgtccggtggtcgtgacctccagttcgccgttggcgctacgttgcagaatgccgcgctggaaatcgagacgccccggcgttttcttcaggcgagatgctgtgcgtacacgctggcgcggcggcactgcgcttgccgtgttgccgccaagcttcgccagtaagggctgaaccagttgataaaacgtgagcgccgcagagactggattccccggcaggccacagaaccagctattactgagcttgccgaaggcaaacggtttgcctggcttgatagccagcttccagaaggcgatttcgcccagctcctcaaggatggttttggtatagtccgcttcaccaaccgagacgccgccggagcttatcactacatcggcctggctgtcggcgtcgataaacgcggcgcgaagcttaccgggatcgtcaggaataatgcctaaattgatcacttcgcagccaagctgttgcagcatcaaatgtatagttagacggttagtgtcataaatttgtcccgcctccagcggctggcccggaagctggagctcgtcgccggtcgagaacagcgctacgcgcactttacgtacaacctgcgcatcggcaattcccagcgacgccagcactggcagttcggcagtagtcaggcgcgtaccggccggaaagaccaccgcatcctggcgaatatcctcgccgcggcggcggatgttttgtccgcaacgaacatcggcggtaaaacgcacgccgtcatcggtttgttccgtctgctcttgcatgactaccgcctcgcaacctgccggtaccggggcgccggtcataatgcgaatgcaggttcccgcaggccactctccctggtagggctgaccggcaaatgctttgccggcgacgggcagcggcttatcggcggacaaatccgccacacgtaccgcataaccatccatagctgaattatcaaagccggggacatcaaggggagatacgatatcggtcgccaggatgcggccaaagcagttcaccagcggcaacgtttctacggcggtgagaggggtaatacgtgaaagcatctgggtcagcgccgtttcaagcggcatcaatccggcggaaaattccatgaacatactcctgcgaggcaaaatcgaatccggctattatgtcagaaaacagtggcgggcagtatgctacctcggtcttagagacggccttgcgcctttacataccttacgcatctttctatattcaaaaatcgaatgaataactcacaacaattctgatagttatagtaaaagttgtgtgccaccgtaatggaccctaaaaatgaataaagcagtgattgcgattcacggcggcgcaggcgcgattgctcgcgcgcaaatgagccatgagcaggagctacgctatatccaggcgttgtcagagattgttgaaagcgggcaaaagatgctggaagcgggtgacagcgcgcttgatgtagtgacggaagcggtgcgcctgctggaagcgtgtccgctcttcaatgcgggtatcggcgcggtctatacccgagacgggactcatgaactggatgcctgcgtgatggacggcaataccctgaaagccggagccgtcgcgggcgtgagtcatgttcgccatcctgtgctcgctgccaggctggtgatggagcgcagcccgcatgtactcatggtgggggaaggggcggaaaactttgccttttcacaggggatggcgcgcgtttcgccggatatcttttccaccccggcgcgttacgagcaattgctggcggcgcgtgcggcgggtgaaatggcgctcgatcacagcggcgcgccgctggacgaaacgaaaaaaatgggtacagtcggcgcggtggcgcgggataaattcggcaatctggcggcggcaacgtctaccggcgggatgaccaataaattgcccgggcgcgtcggcgacagcccgctggtcggcgccgggtgttatgccaacaacgccagcgtcgccgtttcctgtaccggaacgggagaggtctttattcgcacgctcgcggcttacgatatcgccgcattgatggaatatggcggactcagccttgccgacgcctgtgagcgcgtggtgatggaaaaattaccggcgctgggcggcagcggtggattaatcgccgttgatcacgaaggtaatgtcgcgttgccgtttaacagcgaagggatgtatcgcgcctggggatatgccggggatacgccgaccacaggaatttaccgggaataaggagccgcaggtgccgcacagcgatgaactggatagccgcgatgttctgtccgtcagtggcctgaatatcgcgtttcaccacgaagggcaacaggtagacgccgtgcgtaatgtgtcattacgcctgaagcgtggagagactctggcgattgtcggcgagtcgggatcgggaaaatcggtgacggcgctggcgttaatgcggctgattgagcagtcgggcgcgaacgtgcgctgcggcgaaatgctgttgcgtcggcgtaatcgtcaggtgattgagctgtctgagcagagtgacgcgcagatgcggcgtgtgcgcggcgcggatatcgccatgattttccaggagccaatgacctcgctcaacccggtatttaccgttggcgagcaaattgccgaatctattcgtttgcatcagggggccagccacgaagaggcgctggcggaagcgaaacgtatgctcgatcaggtacggatcccggagtcgcaggcgattttatcgcgttatccgcatcagctttccggcgggatgcgccagcgagtcatgatcgcgatggcgctatcctgccgtccggcggtattgattgccgatgaacccaccacggcgctggatgtcactatccaggcgcaaattctgcaacttatcaaagtgttgcagcaagagatgtcgatgggcgtgatttttatcacccacgacatgggcgtcgtggcggatatcgccgatcgcgtgctggtgatgtatcagggcgaggccgtggaaaccggcagcgtagagcagattttccatgcgccgacgcatccttatacccaaacgttactggccgccgtccctcagcttggcgcgatgcgaggccactcgctgccacgccgtttcccgttgatttccgctgacgaaccggccctttatgaatcgcagattgagcaagacacggtggtggaaggcgaacctattctccaggttcgggggctggtgacgcgattcccgctgcgtagcggtctctttaaccgcgttacgcgtgaagttcatgccgttgagaatatcagtttcgatctctggcccggcgaaacgttatcgctggtgggcgagtccggtagcggaaaatcgacgaccggacgcgcgctgctgcggttggttgaatcccggcagggggagattatctttaacggccagcgcattgacacgctgtctgcgggtaaactccagccgttgcgccgcgatattcagtgtattttccaggacccttacgcctcgctcgacccgcgccagaccgtggggtattccattatggaacctttacggattcatggcctggggcagggggacgctgcggcaaagcgcgtggcctggttgcttgagcgtgtcggattacgtcctgaacatgcctggcgttatccgcacgagttttccggcggtcaacgtcagcgcatctgcatagctcgcgcgctggcattgaatcctaaagtgattattgccgatgaggcggtctccgcgctggatgtttccgttcgcgggcagatcattaatttactgctcgatttacaacgggaaatggggatcgcctacctgtttatttcgcatgatatggcggtcgtggagcgaattagccatcgcgtggcggtgatgtatcttggtcaaattgttgagatggggccgcggcgcgccgtttttgaaaatccgcagcatccttatacgcgtaaattgatggcggcggtgccggttgccgatccctccagacaccggccgcggcgcgttctgctatcagatgatatacccagcaatattcataaacgtggcgaagagacgcccgccgtttcattacagttggtcgggccgggacattatgttgcgcggccgctgcaggataatgcgctctcgcgcttataacattcagacaggcagggtttcaggagaacaacatgacgcaatttattacgcataaatggctggcggcgctgggactggcctcatccattgcggcttttccggccctggcggccaaagatgtggtggtggcggtagggtctaatttcaccacgctcgatccgtatgacgccaacgatacactctcgcaggcggtggcgaagtcattttatcaggggctgtttggcctggataaagacatgaaggtaaaaaacgtcctggcggaaggctataccgtttctgatgacggtctgacctacaccattaccctacggcagggggtgaaatttcaggacggcgcggattttaatgcggcggcggtaaaagcgaatctcgatcgcgccagcaatccggataaccacctcaagcgttataacctgtataaaaatatcgcaaaaacggaggttgtcgatccggcaacggtaaaaattaccctgaaacagccgttctccgctttcattaatattctggcgcacccggcgacggcgatgatctcgccgcaagcgctggaaaaatatggcaaggatattggttttcatccggtcggtaccggtccataccagcttgaaacctggaatcagaccgactttgtcaaagtgaaaaagttcgccggttactggcagcagggcttacccaagctggattctattacctggcgtccggttactgacaacaatacccgcgcggcgatgctgcaaaccggcgaagcgcaatttgcttttcctatcccttatgagcaggccgcgttactggcgaaaaataaaaacctcgaactggtcgccagcccgtccattatgcagcgttatatcagtatgaatgtgacgcagaagccgtttgataatcctaaggtgcgtgaggcgttgaattacgctatcaatcgtcaggcgctggttaaagtggcgtttgccggatacgccacgccggcgacgggcgtggtgccgccgtcgatagcctatgcgcaaagctatcagccgtggccctatgatccggctaaagcgcgcgaactgttgaaagaggcggggtatccagacggtttcagtaccacgctgtggtcatcgcacaaccatagcaccgcgcaaaaagtgttgcagtttacccaacagcaactggcgcagattggcgttaaagcccggataaccgcgatggacgccggccagcgcgccgcggaagtcgagggcaaagggcaaaaagagagcggcgtgcgaatgttctatacaggctggtcggcgtcgacgggcgaagctgactgggcgttatcgccgctcttcgcatcacaaaactggccgccgacgcagtttaataccgctttttacagcaacaagcaggtcgacagcgatttggcggcggccttaaagaccaacgatccgcaggagaaaacacgattgtacaaagaggcgcaggatattatctggaaagagtcgccctggataccgttggtggtggagaaattggtttctgcgcacagtaaaaatttgaccggtttctggattatgccggataccggtttcagctttgacgatgcggatttgaagtaagtaatgcgatggggctggatggcgcgcgcgttgtccgccatccggtaaaaggttcgtgtgatgcttaactatgttctcaagcgcctgctgggattaattcctacgctgttgattgtggcagtgctggtgtttttatttgttcatttgttgcccggcgacccggcgcggctgatagccggaccggaagccgacgcgcaggtgatcgcgctggttcgtcagcagctggggcttgatcagccgcttcatgtccagttttggcattacatcacccatgttttacaaggcgatttcgggacgtcaatggtttcccgccgcccggtttctgaggagatcgccagccgctttttgccgacgctgtggctgacgataaccagtatgatatgggcggtgctgtttggcatggcgatcggcatcgccgccgccgtgtggcgtaatcgctggcctgaccggttaggaatgacgcttgccgtgaccggcatttcttttccggcttttgcgctgggaatgttgttaatgcagattttttccgtggatctgggctggctaccgaccgtgggggcggatagctggcaacattatattttaccctccctgacgcttggcgcggcggtggcatccgtcatggcgcgttttacgcgctcctcgtttgtcgatgtcctgagcgaggattacatgaggaccgcgcgggcgaaaggcgtcagtgaaacgtgggtggtgttaaaacatggcctgcgcaatgcaatgatcccggtcgtcaccatgatgggactgcaatttggctttttgcttggcggctcgatcgtcgttgaaaaagtgtttaactggccggggcttgggcgattactggtcgactccgtcgacatgcgcgactaccccgtgattcaggcagaagtgctgctgttttctctggaatttattcttatcaacttagtggtggatgttctctatgccgccattaatccggctatcaggtataagtaaggatgcgattatttaactggcgccgtcaggcgattttacatgctatgccggtggtaaaacccgaccagatacgcacgccgtggcgggagttctggcgtcgttttcgccgccagcatgtcgcgttggtcgccgggggattcgtactggcgttaattctggtggcgatttttgcccgttggctgacgccctacgatgcggaaaactattttgactacgatagcctgaacaatggcccctctttgcagcactggtttggcgttgactcgctgggaagagacatctttagccgggttctcgttggggcgcagatctcactggcggcgggcgtgttcgcggtatttatcggcgcgataatcggtacggtgttgggattgctggcgggatattatgaaggctggtgggatcgttttattatgcgcatttgcgatgtgctgttcgccttccccggcattttgctggcgattgccgttgtggcggtgttaggcagcggtattgctaatgtgatcgttgcggtggcgattttctctattccggcgtttgctcgtctggtgcgcggaaataccctggtcttaaaacagcagacgtttattgagtctgcccgcagtatcggcgccagcgacacgacgattttgtttagccatatattgccgggaacggtctcgtcaattgtggttttctttacgatgcgtatcggtacgtcaattatttccgcggcaagcctgtcatttctcggattaggcgcgcagccgccaacgccggagtggggagcgatgctcaatgaagcgcgggcggatatggtcatcgcgccgcacgtagcgctcttcccggcggtggcgattttcctgactgtgctggcgtttaacctgttaggcgacgggttgcgcgatgcgctggacccgaagattaaggggtaagccagcccggtggcgttgacgcctggcgggcctggaacgggctcgtcaggcgggataacacatccggcacccgcgccgggggaggtggcgttaaacccgactgccccacaaatcatattcgtcggcgttttccactttcacgcgcacgatatcgcccggcttgacgttggtttcgccgttcaaatagaccgcgccgtcaatttccggcgcatccgccatgctacgcccgatagcgccttcttcgtcaacctcatcaacgatcaccagaatttcgcggcccactttttcctgcaagcgctcagcggagatttgctgttgcagttgcataaagcggttccagcgctcttctttcacctcttccggcacctgatccggcagctcattcgcgcctgcgccttccaccgggctgtacttgaagcagcctacacgatcgaggcgcgcctctttcaggaagtcgagcagcatctggaagtcttcttccgtttcgccggggaagccgacaataaaggtggagcgtagggtcagttccgggcagatttcgcgccactgcttaatgcgcgccagctggcggtcaacggaaccgggacgtttcatcagtttaagaatccgcgggctggcatgttgcagcggaatgtccagataaggcaggattttgccttccgccattagcggaatcacatcatcaacgtgtgggtaggggtagacgtagtgcagacgtgtccagacgcccagttttgataactgttcgcacaggctcaccatactggttttcaccggttcgccattatggaatccggtgcggtgcttcacatctacgccgtaggcggaggtatcttgcgaaatcaccagaatctctttgaccccggcatcaaccagacgtttcgcttcgcttaatacgtcgccaatcgggcggctgaccagatccccgcgcatcgacgggatgatgcagaacgtgcagcggtgattacagccttcagaaattttcagatacgcataatggcgcggcgtcagttttacaccctgttccggtacgaggcttaaaaatggattgtgcttcggcttcggtacgtaatgatgtacgtgctgcagaacttgctcatagctatgcggcccggtgatttccagtactttcggatgcacttcgcggatctgatcttcttttgcgcccaggcagccggtgacgattaccttaccgttttcgttcagcgcttcgccaatggcttccagtgactcttgtaccgcgctgtcaataaagccacaggtattaacgataaccatatccgcatcgtcatagcgtggcacaacgtcatagccttcggtacgcagctcagtcaggatgcgttccgaatcaacgaggtttttcggacagcccagggaaacgaagccgatctttggctggtgggttacattactcatagcttaaaaagtgttcatttattggaatggtcagggcagggattctacagatatccgaacaaaaattgtatcgcaatctcatcaggagcggcggcatcaaccgttgtggttatcagcaaaaggtgaaaaagggcaattctaagaaaattcttgatctctgacacccctttgtctaaaaaacgaccatactattaagttgaaccctggtagaaaagaggaggaaaaaaggtatggtcgttgacagactgagaaccgatcttctcaacaagctgataaacgcgcgtatcgatcttgccgcttatctgcaattgcgaaaagcgaaggggtatatgtcagtcagcgaaagtgacactctgcgtgacaatttttttgaactgaatcgcgagctccacgatcacgctttacggcagggactgcatctcgatcaggaagagtggaacgcgctgcgccgtgccgaaggcgcgcttgcagccgccgccgtttgtttaatgagcggacaccatgattgtccgacctttattgccgtcaacgcagataaacttgaaaactgtctgacaactttgacgctgagtattcagagtctgaaagcacattcaccgcttacacaggtctgaacaaggggaggcgactcctgaggaatccccagcaaaccaagacaggcatagtgttatgtgatctaattgattgcgctaacactttcaaggaaatcatcactatgcctgctcgttcattatgccaaaaatcctttaaaaatatactggagcctttgcacctttaccgccgtcaatctctgattgaggctaccagtgtagtgattaacggtgcatctcttacacttattcagtattgggcgtgatttgtcaggagtagcatcggtcaggcacaagataaaacgtatcgatcgacttcggggaaagtctcacttgcagaatgaagtttcagatactttttcagcgtgttactaaaaaatcacggagggaatgacccgggttgtcatgctctcctatatgccagcctgttttccgccaaaggtgactaaattcggttcaccagacaatcgttgatgttcttagggaacggtatagtcgaattcactcctgaaacaggtacggaatgtcggccgtttactattctgaaacgttatttatatcaaataattaaattttatttttatctttgttattgtaacaataaattacatgtttctttctgttatcagcgaacctgaaccaattttaatggggggttagataaaagctaattcagaaaattatttttttaagatatattgaattatcagatgctccattcaaatgagagacgagaatgcaaacgttagaacggttttttcttttcgttacgggggaccaacctgaacgatttgaaaaagcaaatagcagttgtgctgatagcgtaatccttgatttagaaaatgcggtgtcatctgagaaaaaaataattgccagagaaaatgctctgaatttcatgagtaatgatgaaaaagtactgattgctgtacgtgcaaaaattgtaataacttcacgcctggctggatcatatccttctgttgacggtatcacaactgaatttatgaaaaacgagttgacaatacaaaatgctattcactcctgtaaaatggggttcagtggcaaggtatgtattcaccctccacaaatttcacatgtaaacagagcattcagctatttaaaacaagaaatcgagtgggttccccagattatgcgactggctcaatatccccatggagcgttcagtcatgaagggcaaatggtggataaaccgttactggaaaaagcaaaaaggattttggctcatagcatttagtaaatatatgaaggagtcaccaatgaaagctttagtttgtgtaaaacaagttgtcgatcataacgttagaattagaataaagcgagatcattctgatgttgatatttctgattcaaaactcagtatcaatccatttgatgaaattgcagttgaagaagcagtacgtttaaaagaacggggattaatcagtgaggttgttgtagtgtctataggaaacacaggtgtaggggatgtattgcgtacagcactggcagcaggggcagacagggcaatacacatattaacaaaaaactctcttacaccactaattgtggccaaaactatcaccgctattacccggaatgaaaaacccgatattatattattaggcaagcaagctattgacgatgattgtaatcaggtaggccaaatgctggcagcattactcgatcttccccaagccactaatgttagtgaaattactatttctgataattcattaactgctgttcgtgaggttgatggaggattagaaacgttaaatttatccctgcctgcagtactcactacagatctacgtctgaatacaccgaggaatatcagcttgccgaatgttattaaagccaaaaagaaacctgttaaggagatagatttcgattcacttggtattaacccgtcatccagattgactattattaaagttgatgagccagcaagaaggaaagcaggcataatcgttccagatattaacacgctgctagataaattaaaaaacgaagaaaaagtaatttaaggaggaaaatatggcttctttagttattgctgaacataacggcaatactcttttaccttcaacactcagtactatcactgcggcaaaagccattaatagtgatatagatatacttatgttaggatatggtatagaaagtattgcagttaaagccagtcatattcaggggatatccactgtatttgttgctgacagcccactattcgaacaccttctggcagagaatgtggaaaaacagatcagctattttttgaatagtgggaaaaatcattatcagtccattctttttcctgcaagctcttttggaaaaaactgtgcgccacgcttagcagcaaaacttgatgtatctcagattagtgatattacgcgtgtcattgatcaacatacctttgaacgtccaatctatgcgggtaacgctattgccacagtacacagtgatgatgaatataaagtgataactgttcgtcctacctcatttgcggctgcggttgcggaagatgagggaaaagcccccattgaatttacagaggttgttcttggttcagatcaggtaaaatttattagccaacatgttaataaaagtaaccgtccagacttacaatccgccagagttgtagtatcaggtggacgaggagtaggaagtgcacaggcattcaaagaacttgttgataacctggcagataaattaggcgctgccgtgggggcaagccgggctgctgtagatgctggttatgcaccaaatgattatcagattggccagaccggaaaaatcgttgcgcctcaactttatattgctctgggaatttctggcgccatacaacatcttgccgggatgaaagagtcaggcgtcattgtcgctattaataaggatcctgacgctcctatcttttctattgcggattatggtttggtagctgatattttcaaagctgtacctgaacttatcgataaattataaatcatattttttcctccttaaaggtaacttttatgcaatatactgatattcaaatttggcagcctggcattctgcgcaacaccgattatcttaaccccggtcccgctaagctgctggccgccactctggataaagacatcaaaatctttaaagagggggggcgttctgccagaattatggcactggctctattttcttcctgtcgaccgccagtcagatctatctgctgatggtcatccgataaaaggtcattttctaccccctgttggcgctggtttattgaggaaaaaattatgaaaagtattgaaaaggataaatatcaggatattcgtgatgcggttcgttcattatgtagtgaatttgatgataaatatcaccgtaagatagatgaagcaaaagcctatcctgaagagtttgttaataaactaaccaaagctggttggctggctgcgctcatcccggaggaatttggagggtcagggcttggtttaactgaagcatctattatcatggaagagatcaatagatcgggtggaaactctggagcctgccatggtcagatgtataacatgaatacgttgttacgtcatggatccgataaacagaaagaattctggctgccacggatagctactggtgaatggcgcctgcagtcgatgggcgtcacagaacccacagcaggtacagataccaccagaattaaaactacagctgtaaaaagagaagaccggtatgtgataaacggacaaaaagtctggatttcacgtgttcaacattcagactggatgattcttctggttcgaactactccgcttgcaaatgtaaaacgtaaatccgaagggatgtctattttcatggttgatattaaagaagctatgaaaaatggaatgacagtacgacctattcccaatatggtcaatcatgaaaccaacgagctcttttttgacaacctggaaattcccgaagaaaatcttattggtgaagagggtatgggttttcattacatacttgatggtttaaatgcagagcgtaccttgattgcggcagaatgtataggcgatggatattggtttatggatcgtgttacccgctatacctgcgagcgtgaggtttttggtcgtcccattggtcagaaccagggggtgcagtttcctattgcagaagcatttattgcagtggaagcggctaatctgatgcgttttaaagcgtgcgagctttttgatcagcatcttgattgtggagcacaggctaatatggcgaaataccttgctgcgaaagccagctgggaagcagccaatgcctgcctgcaatttcatggtggatatggttttgcctgtgagtatgatatcgaacgaaagtttagagaaacacgtttatatcaggttgctcccatatctaccaacctgatcctgagctatatcgctgagcatgtgctggagatgccacgttcattctgatgtcaaatcaattggaaaaatattatgaaacagttacctctgtccggagtcattatagtctcgattgaacatgtcattgccactcccttctgtacccgacagttggctgattatttctcgcgggtaactataatagaatgccaagaaaacagggacttttcctgcaattatgatgaacggcttaaaaatgatttgtgtatattctttttcatctgagggagaaagctaaatataaatgttatggaatgcttcatcatcatcgacatttttttaatagttgataactggctatatagtcttataggcacctttttctaaggttgaacattcctataccatttcatctgttttatcactatgatatttatttcattggttacaatatgaatgcaattttatttacataatatagctgttcctacggtgctgaaaaattaaggagttaataatgaacgatacactttctaatacccagcaatcacgtgagacaatagaatgtgatgttcttattgtgggagcaggacccgccggattatctgcagctcttaaacttaaattacaggcaaatgacgcaggaaaagaactgtccattatcgtccttgataaaggagctgagcctggttctcatattctcagtggggcagtcatggatccccgagcgctgaatgaactaattcctgattggcaggaaagaggcgcacccattaaacagcctgttactcaggataaattactgttactgacgaatgaaaaatgtattaatttgccggatgcattgattcctgataattttcgcaaccatggaaactttatcgtaagcctcggtaatctcattaaatggctcgccggtcaggcagaaacgtcaggcgtggatatttatgcaggcttttcggcaactgagatactgtatgatcaggatactaacattatcggtgtagtaactggtgatatgggacgtcatcgggatggcagcaagaaagaggggttcctgagtggaatagaaattctggcaaaatatacaatttttgccgaaggggcccgcggtagtctggctaaagaactgatcaaaaaatttcatcttgatacaggcaaagcaccccagagttttagcataggcataaaagagttgtgggaggttccatcagaccagtcccatccggggcttgtaattcacaccacaggttggcctctggataaagagtcgttcgggggtgggtttctctatcatcttaatgataataaaattgcactaggtttggttgtgggacttgattattcaaatccctggttaagcccttttcaggaaatgcagcgcctgaaaacacacccttctatacgcaaatacattgaccggggtaagcgtattggttatggcgcaagagcaatcaataacggcgggattgcgtctatgcctgatccctgtttacctggtggtctgctgattggttgtaatgccggtacgctcaatgcaagtagaatcaagggcatccatacagctatcaaaagtggcatgatagcggctgacgctatatttaatgctttgctggacaacaggaaaaacgacatactgacagaatatcaaacattactgcgacagagctggctttggcaggaactggaaaatggtagtaatttcaaaccctggtttaaaaaagggcgtgtgataggttttattatgactggcattgagcattggctgcttccccgaatgggtataaaaaaaatcccctggcgtgtaaaaaataaccgaccggacaatatcactctgcaaccggccaacaaaagccagaaaaaactgtacgacaaacctgacggtaaactgacgtttgatattttgtcatccgtctatctcagtaacacctggcatgatgacgaccagccagtacatttgaaaatcagtgatcagaatatccctatatccattaatctggatatttatggtggccccgaagaacgatattgccctgccggagtatatgaatttttacaggatagtgaaacacaaaatatgcgtctgcaaataaattcacagaactgtattcactgtaaagtttgtgacattaaagatcctaaacaaaatataacctggactacgcctgaaggtggcaacggaccaaattatacagggatgtaacgctatcactcagtctgagctgtgagcatagtaaccagtttttgtgtgaagccgggtaatttgtcaaagcttctggcgcagatttgtaattttcttaatgaccaaaattcatcaagatcaataatcgaaaattcatgcaactgacgcaaacgggatgcagcagagtgaggcattataccaatgcccacttttgcttcaaccatacggcaaaatgtttcaaagttgccgacctgtattctaattttcagtttagatggtactagttctgccttttttcggataaattcaaacattcctgtcccttcaggcaggctgatttgttcatattgaattaattcatgaaaggtcacgctttttctgtcagcaaagggatggtctgtcgcggtgataagcactagcctatcagtacggaacggcagtatttcaagattatctgttgtaatattaccagcaacaattccgagatcagttttcccctcaataacagaacgtacaatttccggacttggatactccctgagatcaatattcacatcgttatatagtgtaaggaaatggcttaacaatggggggagatactctgcaatagcagttatactggaaaatattctgacatgtcctttgatgcctttaacatgctcctgcatatcgctacgtaacatttccatctgattcacaataaggctggcgtggtgtttaaatgtttcaccagcagaggataacgttatccccttgctactacgatacagcaatctcagattgatactctgttcaagattacgtatacgcacgctaccagatgcggcagacatgtaagttttttccgctccacgtgttatgctcccttcttcactgatagcaaggaataattttaaatcttttatatcaaagtgcatcgttgtggctcataattaacgtataatacagtgtgctgcttttttatagactcagtcagactgagtatttcggcctatccgaattcctgtcacgtcgagataactacaaaatgtaggctgacggtgtcaccgccctaccatgatccggggcggatctggtaggacgctggtgaccgctgacagggggtcaggtcagacatattgtcggaaccgttgtaacgtagatgctaatacctgctccccgtggtcatcaggttaacccgtttacagcggttttttcagccccggcagatttatcataaactgatcaccgtaaatatgtggaatcagccaagtaaagaacagattggcaaacgccaccacaaacaatgatacgcctccataggtcaataaagcgcatacaagaataatcatcggcatggctttgttctggcccaccatacaggtcacagcactgacaattgagtagtaaaaaccagcaagttcaatcagcttgccaaatactgcacccagcagaaagacaggaaaataaagttttacaaaaccgatcaacttatccataaatatatcactgaaaaccggggcgaccgtcactggacgggtgaacagaactgcgccaagtgctaccagcggagcaaaaaggatcacactgtaaccacgataagcgaccagcatcagtaatgaatacattcattgtcttatctcgctagcatgactacccattttatccatgttatgcaacagcttgtgtcatatttttctgatctccattttagatcagacaggctattactcagggattccggcgcgaagaatggaacatactctaaaaagtactcggcggattcaagtcggtatcactccgttaataatctttattctcgacccgctgcatgttgattttacggttaaacgccgttctcttattcatcgcaggagtaaaccatcatgacacgcagtgaaatccccagaaaacgatcatgtattcaatcgttgattatcgtttcgaataccgacttttatcgcaggatttatgatggctaaagtcgatgtgaaatgcccgttttgcgcgcaaacggcatccgttaaaaagtatggtccggggagtgcagggcaccagcattaccgctgtcaggtatgttgccgcagctttcaggtcgactatgaataccgcgcctgtcagcccggcatgaaagagcaggttgttgatcttgccatgtacactgccggtattcgtaatccgcaggggctggccatcaatccctggagcggcgcgctatggctgcatgaacacggtccgcgcggcggcgatgaaattaacatcccggaaaaaggcaaaaattatggctggccgctggccacatggggcgtcaactatagtggtctgaaagtgccggaagccaaaggtgaaattgtcgagggaacggcgcaaccggtttactactggaaggattctccagcgatcagcgggatggctttttatgccagcgacgtttttgcgccgtggcggcacaaactgtttatcggcgcgctaaaagataaagaggtcattgtgatgcgcgtcgatggcaatacggtgacggaagaaggccgtattctgggtgacagaaagcaacgtatctacgatgtgcgtgtcggacctgacggctacttatatgtgttaaccgatgagtccgacgggcagttactcaaggtaagtcctgcagccacgcgttaggtcaccgggatcatcaccactttgcgaaaagcagggcgctcggtaagctgctgataccagcgttccagattcgggcgcggcgtccatttcagacccacgttcagcaggttatagacgaaaggcgcaatagcgatatcaccggtgccaaagttatcccctgagaaccacggctggtgggccagcgcatcatcaagaagcgcaaacaggctatcacacttttcgataccggcttcaattgccgcctggtcgcgtttttccggcggggttctgaccagtcccatcaggatcacgcggtgcgccgggcttaacgtttgattcgcccagtccatccatttttcgccctccgcacgccgcgccggattatcaacccatagccggttctggccgtattgcgccgccagatagcggacaatggcattggattcccacaataacaggtcggtttcatcatctttaagcagcggcaccagcccattaggattcatcgccagatagtcggcatcctggttaacgccgaattttccgcctgccagaatttgatcgtatggcagttccagctcttcaagcgtccacaacacttttttaacattagtcgagttgttccggccccacagcgtaatcatattaaccccttccgttttatcaggatgatgacagtaatcggcctaccgtgagataaacctaacatttacacaatggtctgtaaaaaaatcgttatgaaggaagcgtaacgggatgttattgcataaactttaaaaactttaccaagttacggtttctttaacgtcgtgagtgcgttattactcaccgcacttattacacggtggtgtgacgtgtgtttttggaatggatactcgggtggtactatgacgcaatacgcttcttcccttcgtagcctcgcggcaggttcggttctcttattccttttcgcttcgcctgtaaaggcagaggaacaaacgatcgcgccgccgggcgttgatgcgcgagcctggatcttaatggattacgccagcggtaaagtactggcggaaggcaacgccgatgagaaactcgaccctgccagtttgacaaaaattatgaccagctacgtggtgggccaggcgctgaaggcagggaaaatcaagctgaccgatatggtgacggtgggcaaagatgcctgggcgacggggaacccggcgctacgtgggtcgtcggtgatgtttctgaagccaggcgatcaggtgtcggttgcggatcttaataaaggcatcatcattcagtcaggtaacgatgcctgtatcgcgcttgccgactacgtcgccggaagccaggagtcctttatcggcctgatgaacgcctatgcgaaacgactggggttaaccaatacaaccttccagacggtacacggtcttgatgcgccagggcagttcagtaccgctcgcgatatggcgttgctcggcaaggccttgattcacgatgtgcctgacgaatacgccattcataaagaaaaagaatttacttttaataatattcgtcagccaaaccgcaaccgcctgttgtggagcaccaatctgcatgtcgacggcatgaaaacggggacaacggctggcgctgggtataaccttgtcgcctccgccacccagggcgatatgcgcctgatctctgtcgtgctgggggcgaaaacggaccgtattcgttttaatgagtcagaaaaactgctgacctggggtttccgcttctttgaaacggtcacgccgattaaacctgacgcgacattcgtgacgcagcgggtctggtttggcgataagcatgaggtcaatttgggggcgggcgatgcggggtctgtgacgattccgcgtgggcagcttaaaaacctgaaggccagctttacgttgaacgaaccacagctcacggcgccgttgaagaaagggcaggttgtcggcaccatcgatttccagcttaacggaaaatccattgagcaacgcccgttaatggtgatggaaaacgtcgaggaggggggatttttcagccggatgtgggattttgtgctgatgaaactccatcagtggtttggcagttggttctcgtaaaataactccgtagccgggtgcgcgtcgcatccggctacgggcggttaatacatcagagtaatttgttgcgctttagcgtaggccacaaaggcctcatcgggacggcggtcgctgataatcgtatcaaagcgtgataattcccccatccgcgccggacgtaccttgccgaatttactgtgatccaccaccagtacatggcactgtgccattgtcattgcccaatgttttaccggcagctcttccagattaaagcaggtagcgcctttactggtatgaacgccagcggcggaataaaacgcgatatccggacaaatattgtttaacgtttcatggaaatcaagcggtttgaaaatggcgttgctggcgtgaaactccccgccgctgaggatggcgcggcaatggggtttgtcctgcagcgccaggaaggtattaagtgaatagcacaccgccgtaaagggaaggtcattatcaatggcttcaatgatccacggcgtggtggtgccgcagtcaataaataccgtctgatgcgcttgtaccaggcccgcagccagctgagcggctcggcgtttttcttccaccagacgagatttttgatcgcttaacagataatgactggcgctgcggggctccagtacgatatagccgcctagcaacacgacaggcgcgcttttatggttcaggtcgcgacgaatggtcatttcagagacgcccaacagggtcgcggcttctttaagatgaagtttatcgctgcgttttaaggcctgcagcaattgaccaatacgctcgtcgcgtcgcgtttccatagttcccctggagagttaaataagcgctccgcaccatacagagcgcttaatattactctttttttcgctatttagtcacgtacccagccttttcgaatgggcaatgcgaaacagaaacggtaacaacgttgcagcgcctggtagagcggcgcgccgtaccactgccagatcagctgtgcgctcaggcagccaagcatcgctaccagcagcgcgccaatcatatctaacggccagtgtacgccgagatagacgcgcgaccaggcgatggtaatggctatcgccatcatcacgatgcctgaccagaggcggtgccagaacaaaaacgccagcgcaaaggtaaaaatcaccgtaccgtgatcgctggggaacgagtcatcggcggcatgatgcaggaagttatagccgatatgatcgacaaacggacggtcgtgcgggaaaaggtgtcccattgtccaggagaccgccagactgataatcagcgcgatgccgattttaacgatcagctggcgctgggcgcagacccgatcgcggggcccccacagccagagtaccacggctaagagcgggacgatgttgatgacatctttggcgataaagatagcgagcgaaattatccactgcgcggaatcaggcgtggcgttaataaaataaaacagcgagttgttaaggttttccagcataacatccaggctcggagcaatgaaatcaaaagggatagccagctcatccccgtgcaaactgagcataaatgcagcgtaacagggaggaaaagcagtattgtcttatttggcggcaacatgaagagatttaagacaatggcataaaataacgttgatgataacggcgcaaacttaaattaaccttaaagtacgcaagcgctaagcggctttctgtaaaaatgtgcgctatttcccttgcagcctcataattcgctatctcagttccccgactttcattacactctgcgcggtttttattggcgaagagatggtatgcagaatcgtttacaatcaggcggcaggctgggacgtcaggcgctgctttttcctctctgtctggtgctgtacgagttttctacttatattggcaacgacatgatccagccgggtatgctggcggtggttgagcagtatcaggcgggcctggactgggttccgacgtccatgaccgcttatctggcgggcggtatgttcttacagtggctgcttggcccgttgtctgaccggattggccgtcgtcccgtgatgctggcgggcgtcgtgtggtttattgtcacctgcctggcgacgttactggcgaaaaacatcgaacaatttaccttcctgcgttttttgcaagggattagcctgtgttttatcggcgctgtagggtatgccgcgattcaggagtcctttgaggaggcggtgtgtataaaaattaccgcgctgatggcgaacgtggcgttaatcgcgccgctactgggaccactggttggggcggcatgggtgcatgttctgccgtgggaggggatgtttattttatttgccgcactggccgctatcgcctttttcgggctacagcgcgcaatgacggagaccgccacgcggcggggcgaaacgctgtcatttaaggcgctgggccgggattatcggttggtgataaaaaaccggcggttcgtcgcaggggcgttagcgctgggatttgtcagcctgccgttgttggcctggattgcgcagtcgccgattatcatcattagcggcgaacagctcagcagctatgaatatggtctgctgcaggtgcccgtttttggcgcgctcattgccggtaatctggtgttggcgcgtttaacctcccgacgtacggttcgctcgctgatcgtgatgggcggctggcctatcgtcgcggggctgatcatcgccgcggcggcgacggtggtttcatcccatgcttatttatggatgacggcgggattaagcgtatacgcttttggcattgggctggcgaatgccggactggtgcgtctgacgctcttttccagcgatatgagtaaaggaacggtctcggcggcgatgggaatgctacaaatgctgatttttaccgttggcattgaagtcagtaaacacgcctggttaagcggcggcaatgggctatttagcctgtttaatctggcaaacggtattctttggctactgctgatgctggtcttcttaaaagataagcggacggggaatttgcaaacagtctgagagagcggctacgcctgataagctttctgttatcaggcatagagaggcatccgctagacgttgaacggcggctcgttgtttaatacgctgtcgataatatccagcacgccttcctggttgttcgatccggcgcggtatttcgccgccgccgcgactgcttcgctggcgtgcgacatggcaaaactaaacccggcctgacgcagcatctcaatatcgttgccgccgtcgccgaataccaccacttcactatcatgaatgccccagcgctgctgtaacagacgcaggccgttggctttatgcacgccgggaataattaaatcaatactgccatagccggtatgaacgggaaccatgatatcgccaatggcgtcgtgcagcgccgcctgtacttccggtatccgttcatcggtaatattaaggccgaatttgaaaaagacatcgttgatattattaaaattatccacaaactccagacgatgataatacattgccgcaacggcttttaacgcatcgtcgtagcgtttcagcgtgtaggcgctgttttttccacaggcgatgatctccacatcggcgcgtgtgagcaggtgttcgacaaccgcctggaagtcggcttttgtcagctcgccgttaaaaatatcctcgccttcgctgaccacccagccgccgttttccgcgacaaaagcgatttcgtgcgcaatttccggaaagaacgagattaactggtaatactggttgccgctggccacgacaaagcgaatgccttgccgcttcatttgttggtactgcgccataaaccggtcacggttataggttttttgatcgctcagaaaagtgccgtccatgtcgacggcgattaatttgatactcatgcgttatgctccatcaccggttgcggagtcgatacaggtttggcgacggccttcgccaccagcgccgccagaataaccagcgccagcacaaccatcatggcgctgcgtaatccataatgctctcccagatagcccaacagcggcggcccgaccaaaaacgccagatagccggtcgtggcgacaacgctcacgcgcgtcggcgcgtcgggaccggtatcgctggcggcggaaatggtcagcgggaagccgagcgaagcgcctaagccccaaagaatgaccgagacgccggcgacccagtcgctatcgacaaaaataatcaggccaatgcccagcgctcccatcaacgcgctggcgcgaacaaccgtcacccggctatagcggtcaataaaccagccgccggtaaagcggccaacggtcataccaagcgtgaaaccggcgtagatcagagagccggaggttgggctaaaaccgtgtccgtctaccatcagtagcggtagccagtcattcgcagatccttcggcgaatgccattgccagcaccaccacgccaataagcaaaagctggatgtcccgataaaaaggtaatcctttttcctgaaggtgagaatcttccgatgcgtttttacccgtaccgtcagggatcgcccgaatggcgatgaaaatgggcgcgatcgccacggcagccgcgaggatgatatggatgttagccgggacgcttaatgcggttaacgccatgccgacaccagcgcccgccagcgtgccgaaactgtagaaaccatgcatcatcggcagaacggttttattcagctcgcgttcgaccgccgcgccttcgacattaatcgccacttcggcggcgccaaaactggcgccgaaaacggctaatccaagggcaaaaatcagcggcgaggcgcaccacagcgcgacgctaagaataaccatcccggttactgcacaggtcatcgtcgtgcgaataaccttccgggtgccaaatcgtttcaccagccaggcggaacaaagaataccgctcattgaaccgatagaaagcccgaataagaccgcccccatttccgcggtagagacggaaagaatatcccgaatagcaggcgttcgggttgcccaggaggccatcagcagtccgggtaaaaagaagaacataaacagcgcccaggtacggcgttttaaggcgttacgtgaggagaggacggtcatagcgtcaggccagaaaatagaagcgagaggtaaacattagcaagcttgtgtacatttgtacatatcatcgtcatacttcattgtgcagacagtttttactgtctgttttttcagcgtaagcggcaggctactatcgcctgcatcctgaatgagatgtggaactcatcatgaaagaaaatgccgtaagacgcgccaatgatcctaagcgacgggaaaaaataattcaggccacactggaagcggtaaagacctatggcgttcatgccgtgacgcaccggaaaatcgccgctatcgctcaggtgccgcttggctcgatgacctactattttgccggtatggatgcgttattgagtgaagcttttacacttttcaccgagaacatgtcgcgtcaataccaggacttttttgcgcaggtgacggatgcggagggggcgtgccaggcgataacggaaatgatttacggctcgcaggttacgacgccggataatatggcgttaatgtatcagttatatgcctatgccagcgataagccggcgttaaaaatagtcatgcaaaactggatgcagcgtagccagaatacgctggcgcagtggtttgacgcacagaccgcccgagcgctggatgcgtttatcgaggggatgacgctgcattttgtaacggatcgaacgccgctggcgcgtgaagcgattttacagatggtaaagcgaatcgccggagtgtcaatgtcgtgtcactctgcgttgggcaacaaaaaacccaccaaccttgaaccgaaatggcggggttgatgggctccacaaaatggggacatcaaagaaaagcagtggcaataggtatgactgatgctttaacgaaaagttcgacctattggcaaaattttttcacttaaaggcaaacttcagttttatcctaaccccggccagatgatgacaataagcgtccccgccagcgttagcagaacgttggcgatggcgtaagtccccgcataacccagcgctggaatattactgcgcgccgtatcgctaatgatttccatcgccggggcgcaggtacgcgcgcccatcatggcaccgaacagcagcgcccggttcatgcgcagcacataagcgccaaacaagaagcagatcaccaccggtaccaggctgacgacaagcccggcgatcagcatttgtccgccgaccgcgcccagaccgttgctgataccgctgccggcgcttaaaccaacgcctgccataaacaccatcaagccgaattctttcaccatattaagcgcgccctgcggaatataaccaaaggtaggatggttagcgcgcaggaaaccgagcatgatcccggcgaacagcaatccggccgcgttgccgataccgaaactaaaattgctgaactggaaggtaatcatcccgatcattaacccgatgataaaaaaagcgcagaaggcaagcaggtccgtcacctgactatgaatcgaaataaaaccaatgcgatcggcgatggtttttacgcgtctggcgtcgccgctcacctgtaacacgtcgcctttattcagcacgacgttatcgtcgataggcatttcgatctggctgcggatgacgcggttaaggaagcagccatgatcggtcagcttgagctgagcgaggcggcgaccgaccgcattgtggtttttcaccacaatttcttccgtcacgatgcgcatatcaagcagatcgcgatcaaatacttccttaccattacggaagctgggatcgagcctggcgtgcgcgtccggatagccgaccagcgcaatctcatcgcccatttgcagcaccgcatcgccatccgggttcgccagaataccgttacggcgaatacgttcgatatagcagcctgtctggcggtaaatacccagctcgcgcaggtttttaccgtcagtccaggccaccagttccgggccaacccgataggcgcggataaccggcaaataaaccttgcgattagcatcggtatccagaccgcgctcgcgagcaatttgctgggcgctggtttgcaaatcctgatgctgtagtttaggcaagtagcgcgcgcccacgatcagactgaccaacccaatcagataggtcagggcatagcccaggctcagattatcaagagcggaggagagttgggtgctggcgatgccggaatgtcgcagggtatcgcctgcgccaaccagcacgggcgtggaggtcattgagccggccagcataccggccgtcaggccgatatcccagccgaatagcttaccaaggcctaaggcgattagcagagcgctaccgaccatgaccagggcaagcatcagataatttttaccgtcgcgaaaaaaaatcgaaaaaaagttggggccagcctcgacgccgacacaaaaaataaacagcataaatcccagatttagcgcgtcggtgttaatactgaagtgttgctgccctaataatagagagaccactaaaacgccaatggaattaccaagttggactgaacccagacgtaacttgccaagacacaggccaagagccaggaccacaaataataacaggatgtaattcccatttaacaaatctgcgacgtttatattcacggagactaacttcttgtttacgagtaagctgttgaaagaaatggtaatttacgctactgtttttatcatgaattaagggtgcaatcgtattgcatacagcatccaaataaaaacaacacaacaatatatcctgctagtttaatcttattgcgtactaacggctataagaatcgtgcaggtgtgtttttggcatggaatgccacatgactttatctgactggatgcctcacggcggaaagcgtgttcgatagagagtgtcaggaggaacgattgaaacataaacacgggtgggcaagcgttgtctgctgctttgtactctttattgtggtgtgtctttcattaactatgcatgtacaaggcgcttttcgcgcggcagggcatcctgagattggactgttattttttacgttgcctggtgcggtggccagcttttgttctcaccggcgcgaggtgatccgaccgctgatcggggcgatgctggcggcgccgttttgcctggtgttaatgcgcgtggtatttatgcctacccgatcgttttggcaagaactcgcgtggttatttagcgccgtattctggtgtgcgttaggcgcgctctgttatttgtttattagcagcctgtttagccaccggcgaaaaaaacgccgatagcgccctccgtcagagggcgttgccagagcaatcaggcgaaaagattcagattttcttttgcccatgcttcaaaatccgtacagccgccgatatgtttttgatcgacaaaaatctgcggtacggtttctacaggtttacctacggttttttccaaatccgctttagtaatgccttcagcatggatatcaatatagcggtagttgaaatcgtcgcgttctttgctcagtttttccgccaactcttttgcacgcacgcaataagggcaccctggacggccaaaaataacagtaaacatatctctcctcgaacataaagccagacggcgaacaggtgttatcatgccgcgatttacggcagatgaaaagcaggttacgcctgttcctttgataacccagggctatatctgttaagcacgccggaccagaacgttctacactgtgcgtcagttaaccgggaggcttgatatgcgcacgattggcgtgttacccaaaagcgtactgatactggaatacctcggtatgattttgctggcgcttgctctgctatcgcttaatcattaccttacgctgcccgcgccgttcaatacgccgctggctggcgtattgatggttttcctcggcgtcgtgttgatcctccccgccgcggtggcgatgatgtggcgtattgcgcagttactggcgccgcagttgatgaaacgtccacccgacatttcttcccgttcagatagagaaaagcataatgagtccgaccattgaacttctttgtggccatcgttctattcgccatttcaccgatgaacccgtgactgacgcgcagcgagaggccattattgccgccgcgcgcagcacgtccagttccagttttttacagtgcagctctattatccgtattaccgatcgggcgctgcgtgaggcgttagtgcccctgacgggcgggcaaaagcatgtggcgcaggccgctgagttctgggtattttgcgccgattttaatcgtcatttgcagatctgtcctgacgcgcagctggggcttgccgaacaactgttgctcggtgtcgtcgatacggcgatgatggggcaaaacgcgctgacggcggcggaatcactggggttaggcggcgtgtatatcggcggcatccgtaacaatattgagtctgttaccgaactattaaaattgccgaagcatgtattgccgctctttggcctgtgtttgggatggcctgcggataatccggatctgaaaccgcgcctgcctgccgagcttgtggttcatgagaaccagtatcaaccgcttgatgaaaagctgctggcgcgctatgacgagcagttggctgagtattatctgacccgcggcagtaatacgcgacgcgatacctggagcgatcatatccgtcgcaccctgattaaagaaaatcgcccatttatccttgaatatttgcataaacagggctgggcgacgcgctaaaacctgcgggccagtgtatgatacgcgggcttttcagggttttcagcgaggtgcagggtgaaaattgccatattgtccagggatggaacgctctattcttgcaaacgtctgcgcgaagcggcgatgcggcgcggccatctggtcgagatactcgatcctctttcctgctatatgaatattaatccggcagcgtcgtcgatccattacaaggggcgtcgtctgccccattttgacgccgttattccccgtattggttcggccattaccttttatggtaccgctgcgctacgtcagtttgagctattgggtagctatccgctgaatgaatccgtcgccattacccgcgcgcgcgataagctgcgatcgctacaacttctggcgcgccaggggatcgatcttcccattaccgggatcgcccattcgccggatgataccagcgatcttattaagatggttggcggggcgccgctggtcgtgaagctggtagaaggcacgcaagggatcggcgtggtattggcggagacgcgtcaggctgctgaaagcgttattgatgcgtttcgggggctcaatgcccatatcctggttcaggaatacattgccgaagctaaaggatgcgatattcgttgtctggtcgtcggcaatgaggttgtggcggcgattgagcggtgcgcgaaagccggtgattttcgctccaatcttcatcgtggcggggtggccagcatcgcgacgatcacgccccgtgaacgggatatcgccatcaaagccgcacagacgctggggctggatgtggcgggtgtcgatattttacgcgccgcgcgcgggccgctggtgatggaggtgaatgcctcgccgggactggaaggtatcgaaaagactacgggcgtggatatcgcggggcgaatgattcagtggatagaacgtcacgctacgcctgaattttgccttaaaatcggcggctaatcgcaatcgtggattccgccgtagtacgaagcacgctttttgcgtaagctgtgccggtaattttttcatcgtcatcgtaagaggtagcactttattatgatatcactggtcgttcccactctggatacgttgcgtcaatggctcgacgacctgggcatgaatttcttcgaatgtgatacctgccaggcgctgcatttgccgcatatgcagaattttgacggcgtctacgatgctaaaatcgatttggtggacaacaccgttcttttttccgcgatggcggaggtcaggccttccgcgttgctgccgctggcggccgatctctctgctattaacgccagttcgttgacggtaaaagcctttctcgatatgcaggatgataatctgccaaaactggttgtgtgccagtctttatccgttatgcaaggcgtcacctacgaacagttcgaatggtttgttcgccaaagtgaagagcagatttctatggtgatccttgaggccggggcgcatcagcttctgtttaacgcggaagaagacgcgcaaaaaaccagcgcagttgaccattttcttcactaatcccttccgataatcaggcagtcgctgccagcgcggctgctgtttacacttttttatgctgctattaacctttatttaaagaattattcacctcctttctgaccatttcgctttatcacatagacaaaacctgcataaaaaattgataaaaggcgttttttaatctgggctatagcctcaaaccttagctaaagttattcttgcgaagcttctatagcgagcttgatggcagggagggcgacctctcttcttcatttgtatcaaatgaaaaggtatgcacatttcaggcatgttttaaaccacgcctaatgggttcatttgttaacggatttcagaaggaaagcgatgatgaccgccttaaagaaaaaatggctatcgggtctggttgcgggtgctctgatggtcgtctctgtcggcacgctcgctgccgaacaaaaaacgctgcacatttataactggtcagattatatcgcgccggacacggtggcgaactttgaaaaagagaccgggattaacgttatctatgatgtctttgactctaacgaagtgctggaaggcaagttaatggcaggcagcaccgggttcgatctggtggtgccatcggccagttttcttgagcgccagctcaccgcgggcgtttttcagccgctggataaaagcaaacttcccggctggaaaaacctcgatcctgaactgctgaaactggtagcgaagcacgatcctgacaacaaatacgccatgccctatatgtgggccacgacgggcattggctataacgttgataaagtgaaagcggtgctgggggatgatgcgccagtgaatagctgggatttagtcctcaagccggaaaatctggagaagctaaaaagctgcggcgtctctttccttgatgcgcctgaagaaatttttgccactgtgctgaactatctgggtaaagatccgaatagcagcaaagcggatgactacaccggcccggcaaccgatctgttgttgaagctacggccaaacattcgctatttccactcctcgcaatacattaacgatctggctaatggcgatacctgtgtggccatcggctgggcgggcgatgtctggcaggccgctaaccgagcgaaagaggcgaaaaatggcgtcaatatctctttctcgatccccaaagagggggcaatggcgttttttgatgtgtttgccatgccggctgacgccaaaaataaagacgaggcctaccagttccttaattatctgctgcgccctgatgtgattgcccatatttccgatcacgttttctacgccaatgcgaataaagaggcgacggcgctggtcagccagcaggtgcgcgataacccgggaatttatccgccggcggatgtgcgggccaagttgtttaccctgaaagtgcaggagccgaagattgatcgcgtccgcacccgcgcatggacgaaggtgaaaagcggtaagtaatttattaacggtatggcctgataagcgtgcgctatcgggcattccaccgtttgtatcgtttgattgtgttatgccggagagcgccttgtgaatgatgtcccccaccgcccgcaggtgaaaacccgtaaagcgctgacgccgcttctggaaattcgcaacctgacgaagtcattcgacgggcaacatgctgtcgatgatgtcagtctgactatctataaaggcgagatttttgccctgctgggcgcgtcaggttgtggaaaatcgactctgctacggatgctggcaggttttgaaccgccgagcagcgggcaaattatgctcgacggcgtcgatctggcgcatgttccgccgtatcagcgtccgattaatatgatgtttcagtcctatgcgttgtttccgcatatgacggtagagcagaacatcgcttttggtctgaagcaggacaaactgccgaaggcggagattaccagccgcgtcaatgagatgctgggtctggtgcacatgcaggagtttgcgaaacgtaagccgcatcagctttccggcggtcagcgtcagcgcgtggccctggcgcgcagcctggcgaaacgtcctaagctgctcttgttggatgaaccgatgggcgcgctggataaaaaattacgcgaccggatgcagctggaagtggtggatatccttgagcgcgtcggcgtgacctgcgtcatggtgacgcacgatcaggaagaagccatgacgatggcggggcgcattgccatcatgaaccgtggaaaatttgtgcaaattggcgaaccggaggagatttacgagcatccgacgacccgctacagcgccgaatttatcggatcggtaaatgtttttgagggcttactgaaagcgcgtgaggaggacggtctggtcattgacgcgcccggtttggttcatccgttaaaagtcgatgcagatgcctctgtcgttgataatgtgccggtatatgtggcgctacgtccggaaaaaatcatgctgtgtgagtcgccgcctgccgatggctataatttcgccgtcggcgaagtggcgcatattgcgtatctcggcgatctgtctatttatcatgtgcggctaaaaagcgggcagatgatcagcgctcaactgcagaatgcgcaccgttaccggaaagggttaccgacctggggcgatgaagtgcgtttgtgctgggaagcggatagctgcgtggtcctgacggtataagggggaaacatgagcacacttgaacctccggcacgcatcagtaaacctggcggcgcggcgctatggttggcgcgaatgcaaatgaaacatgggcgtaagctggttattgctttgccttatatctggctcattctgctgtttttattgccgtttcttatcgtctttaagataagcctggcggaaatggcgcgggcgatcccgccgtataccgatctgctggaatgggctgacggtcagttgtcgattacgctcaatctcggtaattttttgcaactgaccgacgatccgctttatttcgaagcctatctgcaatcgttacaaattgccggtatttccacaatctgctgcctgctgctgggctacccgctggcgtgggcggtggcgcacagcaagccctccacgcgcaatatcctgctgctgttggtgattctgccctcgtggacgtcttttttaatacgcgtctatgcctggatgggcattttgaaaaacaacggtgcgctgaacaatgtgttgctgtggctaggggttatcgatcagccgctgacgatcctgcacactaacctggccgtctatatcggcattgtttatgcttatctgccgtttatggtactgcccatttataccgcattgacgcgcattgattattcgctggtggaagcgtcgctggatctcggcgcccgaccgctgaaaacattttttagcatcattgtcccgctcaccaaaggcggaatcatcgccggctcgatgctggtttttatcccggcggtgggtgagttcgtgatcccggaactgcttggcgggccggacagtatcatgattggtcgcgtcctgtggcaggagtttttcaataaccgcgactggccggttgcttctgcggtcgccattattatgttgctgctgctgatagtaccgatcatgtggttccataaacatcagcaaaaaagtgtgggggagcacggatgaataacttaccggtcgttcgctcgccctggcgcattctgattctggtgctggggtttacttttctctatgcgccgatgttaatgttggtgatttactcgtttaacagttcgaagctggtgacggtgtgggcgggatggtcgacgcgctggtatggcgagctctttcgggataccgccatgatgagcgcagtgggactaagcctgacaattgccgcctgtgcggcgacgatggcggtggtgctcggtaccattgctgcggtggtgatggtgcgatttggacggtttcgcggcgcaaacggctttgcgtttatgatcaccgcgccgctggtgatgccggatgtgattaccgggctgtcgctgctgctgctgtttgtcgcgctcggtcatgctatcggctggccctccgatcgcgggatgctgaccatctggttggcgcacgtcactttctgtactgcctacgtggcagtggtgatcgcttcgcgattacgcgaactggatcgttcgattgaagaggcggcgatggatcttggcgcggcgccgttaaaggtcttttttgtcattacgttaccgatgatcatgccagcggtgatctcgggctggctgttggcctttacgctttcccttgacgatctggtgattgccagcttcgtttccggtcccggcgccaccacgctaccgatgctggttttctccagcgtgcgcatgggcgtgaacccggaaatcaacgcgctggcgacgttaatcctcggcgtggtaggaatcgtcggatttattgcctggtacctgatggcgcgagcggaaaaacagcggattcgcgatatccagcgtgcaagacgcggctgaagccactaaaatcttccactatggcaatgcgttgccgcgcgggtcgcggcatcattttcagggaagacattcattgggatttataaagcaatcaacctcatcacatgcccgtttaaatgtgcctacgctggtgcaggttgcggctatggcgattattttgattcgcggtctcgatgtgctgatgattatgaataccctcggcatacgcgggatgggcgagtttattcatcgcagcgtgcagacgtggagcttaaccctggtctttctggccagcttagtgctggtctttgttgaaatttattgtgcgttttcgctggtgaaaggccgtagctgggcgcgctgggtgtacctggcgacacaaattattgtgagcggatatctgtgggcggcgtcgttaggctacgggtatcctgagttgtttagcatcgcgggagaatcgaagcgtgatatcctgcattccctggtcatgcaaaaactccccgatcttttaattctgtttctgctgtttattcccgctcccagccgtcggttcttccggctgcaataatgtgtataatcgtcgccccggataatatgaaggttttttggtatgcagtgcgcactctatgacgcgggtcgctgccgttcctgtcaatggattacgcagtcggttaacgaacaactttccgcaaaaacagccgatttacatcgtttgctcgccgggctgcctgttgaacagtggtgcgcgccgattggcggcccggaacagcatttccgcaacaaagcgaaaatggtcgtgagcggtagtgtagaaaaaccgctcttcgggatgctgcatcgcgacggtacgccggtcgatctttgcggctgcccgctgtatcccgcctcctttgaccccgtattcagcgcgctaaaaccttttattgcccgggccggactcacgccttataacgtggcgcgaaaacgtggcgaactgaaatacctgttgctgacggaaagtcagttcgatggcggcatgatgctacgcttcgtgttgcgttcagaaaccaaacttacgcaactgcgcgcggcgttaccgtggctgcgtgcgcaactgccgcagctcagagtgatcaccgcaaatatccagccggtacatatggcgattatggaaggggagacggaaatctacctgacggatcagcaggcgctggcggaacgttttaacgatgtgccgctgtggattcgtccgcaaagtttctttcagaccaaccctacggtcgccagccgattatatgcaacggcgcgcgattgggtagggcaactgccggtacgccatatgtgggatcttttttgcggagtgggcggattcggcctgcactgcgcgacgccgcagatgcaattaaccggtattgagatcgcgccggaggcgattgcctgcgcgaagcaatccgctgccgagctgggattgacccgccttcatttccaggcgttggattccacccaattcgccaccgcacaaggcgaaacgcccgatctggtgttggtaaatcctccccgccgcggcattggcaagccgttgtgcgattaccttgcacaaatggcgccgcgttttatcatttattcgagctgtaacgcgcagacgatggcgcaggatattcgtcatctgccgaactaccgtattcaacgtgttcagcttttcgatatgttcccgcataccgcgcattatgaggttttagcgttactgcgcaggtcaatataatctattcacaatatttatttttatcccttaactatttcataaaaataataaatacaatcaattgattatttaattcaattggttgtatttatatattaccctatttttgcaaatcaaatcacaaataatcactttaaatcttttaatgactacttttgattattacagtgcgtgtaaggcaaaattagacaaggtggtttatcgggtaactttcaatagcatcagcgaagcaatacgtaacgtcagtaaaggggtcaatcatgacaacgaataggcacgcttatggagggcgttcagacgatgtttgccaaatttatagatgttattcaaacgtttttaactgaaccggcaatattaattgggatattagtcggtgttggctatgcgctggataaaaagacgcctataaaaattatcaccggtatgatcagcgcgatggtcggtttgatgatggtgttatttggcggctttcaattttcagccacttttaaaccggttgcagaggcagtcagcaaagcttatggcgtgcatggatacttaatggattcatacgccatgaaagccgcgacgcaaatagcgctgggcgataatttcggctatgtaggatacgtttttgtactggcgttttttactaacctgttattagttttatttggccgttataccggcgcaaaaggtatatttcttaccggtaataccggggtctctcattcacaggcagtactgtggttaatcgtcttctggctggggttcggttgggtacaatccattgtaattgccggggtattgaccggggtcttttgggcgttttcaactacgcttattgttaaacccatcgccaaagtgaccaataacgccggttttaccattgcgcataaccagatgctgggactgtggtttttctcgaaattcgcgcataaattcggcgatccggaaaagcatgacgccgaaaacctgaaacttcccggttggttagccatttttaaccacaacgtgacggcaatcgccattgtgatgacactcttcgttggcggttttctattggcgacagggatcgataacgtacagttaatggcgaaaggcaaaccctggtatatctatatcatcaatctgggcctgcaattctctatgtatatggtcatcttgctgcagggcgtgcggatgatggttggtgaaattaacggttcgtttaaaggatggcaggatcgctttattcctaacgctataccggctgtggatgttgctgctttattacctttttcgcctaacgcggccacgctgggattcgtcttttgtactttcggcacgattttttccatgggcatcctgctgctcatccatagccctattatggtattgcctggttttgttccgctcttcttttccggcggtcccatcggcgtattagccaaccgaatggggggatatcgttccgttattatttgtactttcctgttagggattattcagactttcggtacggtatgggccattcctttaaccgggctggcaaaagaaggtgtgggctggacgggaatatttgactgggcgactctgtggcctgcaatttgtgaattactgaaatttattgcttcaacgttccatcttggtccttattccatttaattgattcggtttatataaaggattttattatgaaagattctgtaaatattttattcgtatgcggttatggtgtaggcagtagcgtaatgttacagactgttgttaaaaaagcgttagcaaaatatgacttctcttttgatatggagcatacggcagcgggagaggtcggtggatttaccgactgggcagatatttatgcgatttcgaaaaaattgcttgatgttgttagcctcgatcctaaacacggacaatatctcattcccattgaaaatatcatggatggcgaatcaataggtaaacagatttacgatgtggtagagaaaaattttccgcacctgctcaacaaatgagggtgagtcatgaaagcgattattctgctgtttgacagtctgaataaaaactatttgccgccctatggtgatttgctaacgaaagcgcctaactttcaacgcctggcggcacatgccgccacctttgacaatagttatgtcggcagtatgccctgtatgccagcccgtcgggaactgcacaccgggcgctataatttcctgcatcgtgagtggggcccgctggaaccctttgatgattccatgccggaattattgaaaaaagcggggatctacacccatcttatcagcgatcatctgcattactgggaagacggcggcggtaactaccataaccgctatagctcctgggacgtagtacgcggtcaggagggcgatcactggaaggcgagcgttggcgagccgcccattccggaagtactgcgcgttccacaaaaacaaaccggaggcggcgtttccgggctatggcgtcatgactgggcgaaccgcgaatacatccagcaggaagccgattttccccagacgaaagtttttgacgccgggtgcgattttatccataaaaatcatgccgaagataactggttattgcaggttgagacgttcgatccgcatgagccgttttataccaccgaggaatatttatcgctctatgacgatgagtggcaaggcccgcattatgactggccgcgcggcaaagtcagtgaaagcgaggaggcgatagcgcatattcgctgtcgttatcgggccctggtttccatgtgcgaccgcaatctgggacgtatccttgatctgatggatgaacacgatctctggcgcgatacgatgctgattgtcggtaccgatcacggcttcttgctgggggagcacggttggtgggctaaaaatcaaatgccctattataacgaggtggcgaataacccgctgtttatctgggacccgcgcagcgcggtatgcggagcgcgacggcagtcgctggtgcagatgattgactgggcgccaacgctactggattattttcagcaacctattcccgcagatatgcagggccaaccgctggcgaaaatcattgccagtgatgaacccgtcagggaaggcgcgctgtttggcgtgtttagcggacatgttaatgttaccgacggacgctatgtttatatgcgggccgcgcagccggggcgtgagcatgacattgcgaactacacgttaatgccgatcaagatgaatgcgcgttatgacgtggatgaactgggaaaattatctctggcgcctccgtttaactttactaaagggcttcaggtattacgtattccggccagggaaaaatataaaggtgtgaatagctttggtcatctcttgtttgatctcagagacgatccgcagcagcaacatcctattcatgatgaggccatcgaagcaaggatgatcaacttacttatccgtttgatgaaagaaaatgatgctccggcggagcagtatcgccgtctgggtctggatgttgtctaaaaacgtaacaatgttgtaagccgggtgcgcgttagcgtcacccggcaagtattagtccgaatcgcctgttgatgcaggcgtttgagactgatgacaaactgtagaatgctcaatggcgctgcgcttatcaggccaggatagtttccgatggcggcccgtgggctgaataaggtatttatactgccatttcgcaacacggtgggctaatcacatacgtcttactgcgggaaccactgatcgctgattttctgataagtgccgtccgctttaatggcggccagcgcattattcagtttttccagcaacgccttattgtccgggcgcaccgcgatgccaagtccggtaccgaagtattgcggatcggtcactttctctgttgccggacccagttgcggattcgttttcagccactcattgaccactgcggtatcgccaaagacaccgtcaatacggccatttttcaggtcgataatcgcattctggtagctgtcgtaggccacggttttgacctccggatgtttatcctggagatatttttgatgcgtggtgccattttccataccgatacgcttaccttttagatcggtaaaggttttataggtgtcttttttggcaatcaccagcgcggagttcgcataatagggattgctaaaggcgacctgcttactgcgctccggggtaatgtccattccggaaatgacggcatcatattttctgaatttcagcgccgggataagactatcgaaagcatgattggtaaaagtacattctgcctgcatttgcttgcataatgcggttgccagatcgatatcgaagcccacaattttattactcgcatccagggattcaaacgggggataggtggcggaaaccccgaaattgattttttcagcggcgatgctgccagtggcgaaagaggcgagtaatgcagccagaactaactttttcatgatgtcactcccgtaatcttatgattatgcgccgtgtctgcggcatagatttacaatgccatcaattgaatttgtatgcaataaaaatgattaaatattttaaaatggataaaaaaagacggacaggttaaccacttgtccgtcggatttattcaatattatgcatcgtaggtttgataagcgcagcgccatctgaccattgtcgaacggcggcgagaatgccttatcctgcctggttaattgcgccgctcaaacgccagagctttacgctcaatcaaacgcatcatcagcgtcaatagaccgttgacgaccaggtaaattacgcctgccgcgccaaataccaccacatcgtaggtacgaccatagagcaactgactgtaccccatgacttccatcaaggtgatggtataggccagcgaggtacttttgaagaccagtaccacctcattagaataggaggagagggcgcgtttaaacgcatagggcaacaaaatcgccagcgtatctttcttactcatccccagcgcgctacaggactgccactgaccttccggaatcgcgcgaatcgcgccataaaatagctgcgtggtgtaagcggcgctgtttagcgacaacgcgatcagtgcgcacagccacggttcagacagtagatgccagagtagtggatactcttgcagcgtcgggaattgaccgggtccgtagtagatcaggaaaatttgcaccaacaacggcgtaccggtaaacagcgtgatatagccgcgcaccagccacaccacgaacggtgtttttagcgtcaggatgatggtaaaaactaacgccagcaccaaagcgacggcaatagaagccacggtcagcgtcaggctggtgtgtagcccttttagcagttcaggtaaatactcaagcattagtccggcctccgctcaaaacgtgtcgcgcgcaggtctatgcgtttgagaatgtactgactgatcagcgtaatgaccaggtaaatagccgccgcaataatgtaccagttaaacggttcctgggtgcgtgtggcaatacttttggtctgcaacatcagatcgttaacgctgataaggctgaccagagccgtatcttttagcaacaccagccactgattacccagccctggcagggcgtgacgccacatctgcggcatcaccagacggaaaaaaatcgccgtctttgataatcccagtgcctgacccgactcccactgaccagacggaacggctttcagcgcgccacgtagcgtctgcgacgcataggccgcatacagcagggacaacgcaatcacgccgcacaggaacggactgacgtcaaagttctcaatctccatttgcaccgggatctgcgtaaagccgagatggagggtaaacccgtcagacagcgtaagcaggagttgcgaggagccgaaatagataaacagcaccaccagaatttccggcaggccgcgcaaaatagtgaccagcgcggagcctatccaggcaatcgggcgccattttacggactcccagacggcaaagaacatggctaacgcgaggccaatgatcagcgcacagacggcaaggccgacggtcatcccggcggcgcttgctaaaggaaaaaattcgttcatcaaagattacttctggaaccatttgttatagatggtctcgtaagtcccatctttcttcactttttccagcgcagtattgaatttctgctgcagctcggtgttgccctggcgtaccgcgatacccaggccggtgccgaaataatctttatcggtgactttatcgccgaccggcgccagcttaggattggctttcagccattcggtcacgaccgccgtgtcgccgaaaacagcgtcgatacggccattttgtagatccagcttcgcgttctgatagctgtcatacggtacggtggtgatttccggatgcttatccatgatgaatttctggtgcgtcgtaccgttctgtacgccgactttcttgcctttcagttgatcaacgctggtgtatttgccctgctgacccacgaacagcgcggagttgtcgtaatatggcgtggtaaacagcacctgcttttcacgttccggcgtgatatccattcccgccattacagcgtcgaagcggcggaatttcaggctggggatcaggctgtcgaacgcctgattggtaaaggtacaggaggcgtcgatctctttacatagcgcgttggccaggtcgacgtcaaagccgacaatcttgttattagcatccatcgattcgaacggcggataggacgcttcggtcgcaaaacgaatggtctgggctgctgtagcggaaaggctaaagcctgcaattagcgcggcaatcagaacttttttcattgtcattgtcccgaatcttagtgagagagatagtttttgaacgcttcggtctgagggtgggcaaagcaacccgcatcaccgtgctcgacgatgtgaccattttccatataaatcacacgactggcggtcttacgcgccacttcgacttcatgcgtaacgatcacctgagtaatgttcgtttccgccagctcatgaataatgctgacgatttgagcggtaatttccgggtccagcgcggcggtcggttcatcaaacagcagcacctgcggctccatcatcagcgcgcgggcaatcgcgacgcgctgctgctgaccgccggaaagatgcaacggataacgatcgctatagggcttcagacgtaaacgctccagcagcttttctgcgcgcgccagcgcctgatcttttgtcagacccagtacgcggcagggcgcttcaatcagattctgcacaacggtgagatgcggccaaagattatattgctgaaagaccattccgacattttgacgtagctcacgaatcgccttatcggacggcgttttcgtaaagtcaaaatggttcccggcgatagtcagagtgccggagcgcggcatctcaagcagattgagtacacgcagcagcgaacttttacccgccccgcttgggccaagcaacaccagcgtttcgccttcggggcaatccagcgtgatatcgaacagcgcctgatgcgcgccgtaaaagcaattaatgccgtttaattgaatactcattgacactcgtatacaggcagtctgatagctattgaagccgcagatagtacctttcgcagaatagttatgcaatatttatgcgttaaaagttaaatatatcccacattcttccctaaacatagcacaaaatagcaggaggaatagtaggtaagaagaattgtcggcatcccgggcagaatgccagacaatttacggggttatgggtgcaaaagcgggggaatactgtctgttaacggttttctatcgactggcgcagcgtaccggcaggggcatggacatctccgcccagatagcgaacgtcgtcaatcacccagcatgagccttcgtgaatcataagcacttcatcctgccagctttgatcgccctgttttaacgctacccgcagaggaatgttgcgcgcatctcggttcggaatggttgatgcgctggcgacgttggcgctatccggcagcgtagcgcggctggagaacagatcgccgctcatcaactggcggtgctccgtatcgcggctggcgtcggttaacaatttcgccaggttatcactcaagtaggggcgaagcgcggcgatatcattgctgtggtgttgaatacggtagtcgtaaaattgttgagccacgctgtccgggccgccttccacacacgcgccgatacgcgggccattatctttgtaggcgggagtgacggtcgtacaggcgctaagcagaagcgcgcacgggatgagcaaagagagtttagaatagcgcatgatgatttccttataggcgatcgagcaaaaaccgatctacgataatcaattatatcctttcagtgattgcataaccacttaacatcttgttttatctaaataaaattaagcatgttatctttttggggcactcctggggcagtagatgccagttgttgattcagtatatctacttgtgactggttattatcagccatccatgctccatatactgtatagaccatctgagcgtttgagtgccccatttgtgaagcaataaagttcgggttcgcgccagcggcaagcgcccagcatgcataggtatgtcgggactggtatgctttcctgtgtcgcagcccggcgcgtctcaatgcagattcccatatcctgttcagggaaggtgcagcataatgtgctttggatttacctgagcgatcggtaatttgcggattgaagacaaaggtgcaggaatgagtttttgtacgaccgtattcgcgcagctttacttcaattttgtgctgtttgctcagcttcgtgaaagaggcctgactttttaaagcatcaattgctggctgcacaagatgtatcaccctgtcggttcctgcctgggttttcggcagggtgaactctttcgcctgggtatagtttctcctgacaatcaaagtccccgctttgagatcgatatcttcccatgccagcgcgcataattccccatgccgcataccagtataaacagccagtgaccaaaggtttttaatttgctggtgatggcaggcgtcaataagacgtgcaaattcttcacgtgaaagtggatctggttcagctttggcacgcttcaacatagttattccattgaatgggttttgtggaatgtaaccgttacgggcagcaaactgaaataatccagaaacaacccccagataggagtttacagttgccacacttcttccttttggcgctaactcgcggcctggcctggtaatatgatggccggtcattaactcctttctgaaaaagagtaaatcttcctgggttacagaagaagcgagaacccggcctcctaataaagaaacgctgatttttatgatcgactcataacgaagcatggtgtttttggatatctccatctctttaagctttagccacttatccgccagttccgccactgtgatttccttattcacaatcccgaatagtttcaggttcggtgagtcagggaattgcgccgcatagtcgaaagtacctaccttgattgcaaagcagaccgaagccctgagttctccggccaccttgcgatttttgggggtatcaggcacccccagattttcacgaacacgcctccccttgtagtggaagcagatacggagtttgtctccgtgtttttcaacgccggttggataggctggtttagccataattcctcctgcgtccaagagcgtcatcagattaccctctcttcagaaaataagtcaaagatcgacatccggatcgggcatatttctaatccacctgtttatcgttggcaggtggtacaggcattcaccgtttgcctttggcttaccatcaagcgtcatgtgcttatactcacgtccgacgaaccacgcctttttacgtgcgcgtaatatggttcctggcttaagtcctgttgacgccattaacacctcatccgtcacccaatcattgggggctatttgatagataattgtttgcatacccgcctcataccacatcaaggccacggcagtggcaccacgtttcgaacatccgcttaaccacttcccggcagtagaatccgtagtcgtcacgtgtcaggtcatagcggtttccgtaccgctggcgaacccatatctcaaattctttgttcatctccacctcccatagcctgaaccgatcccgttacgccctggtatatgcccgacgtgatagttattgcagaacggacagcggtaaacgcccatctgtccctgatgcccgtaacgcttacgaataatccggagttcaatctgtgcaccgtcagcagttttatgtctttttttacatccgcactgtttgcgtctgagacggcgtttgctggtcattacttcacctccacgccgatcccggcgataacacaactccgctcgatcgcttctttcacctggcgtttataggtttcaggatggaaagtttcgttctttcctgtactgctccagaacgcctttgagctggtgtctggcagggttatggtcaacggtttacctgaggtgacaacgttgcaattttgaagcatggcggcgttgtaaccatcggcgaaaatatcagcctcttcatcgttcagttcagcgcccagcctgaaggcaatatctttcgctattgatgctgtaatttgttgtttgagcacgttcatcgtgtcgcctcccgcgatactgttttgtgcgcacgcagcatgtcgcgggatttaccggacaaaaccgtcttcatgaagaacattccactacggtttgcaactattcctggtgtgcagagcagggcagcatcaaccacgcggttatgtttccggaactcaaacacagtgctggtgatgatgatgttcgccacggcaccgtagtcctgatattcgattttcatcccagatgctccccaataactttgattgcattatcacggcagcgcatcacaacgaattcaggattgccgtaagtcgtgttaataaccggatcgaactgaaaacgtaccgcgccatgttcgccggacggctgcagttgcacgggaataaatttccgctcgcgaccaaacatcttctccggataactgagatatttcgcctggataaccggattgatgctgaaatccgcttttttcgggatcactcgctccatatccggaaaaagtccgtcaaccagtttgatacccgtgattgaaattcggcgttcgaatacgtcccggtgatacgcgttttgttcgaaatttgtgcgggactaaaagtcactcgcaaattttcaagttccgggcctgtaatctggaagtaatgtttaccctcaatgaagcgggatttattgcggttgaagttgcggcgaatattctcagcatcggtgccataacccgcagccagttgctcagtagtgactacgcgttggccgcgatactcaatgatctgtaaatcacgcgccgccactgttgctaattcagttttcatagccatctccacttccctcaatacggtttctgcttcatcatttcgtcccaccgggctgcccatgcatcgtatttctcattccatttttgaatttcacgtttacgggccagaatcaggcgcaggcggcgaatggtgcgctggtgagcacgatggtatgcgtcggtggtttcgccacggcgccatacctgttcgccatggtcctgctcaactagaaaatcagggtggcgctgctttaagccggaccgtgtgaaagagtgcgatgtcagaaagtgggccagccagcggatcgcagtgtcccggctaaaacagcgcttcatgcgcccgtgccggatagcagcgtaaaggtcgccgactggcgtatggtgcttctgtaatgccaggtcaattgcgctggctgtgcggttatccaacatttgatatctcctcaaaacggattcctgcttcgcgagccatttcgataaaagtgtccagtgcgcaaatatgttcatcatccagaagttgccgatcgcatataacgcgcccgttttcgatataaagaaccacgcgcccggtgaagttcggcaaaacgtgcagatcgatattcagaactggtagtgggatctgcatgccgcaatacgtcatcatttgctgtgagttcatcagttgattcctccgctgaaatatttctcttttgcccaggtaatgacttcaccgagcaactcatcaacaataagttttcctgtctcggtcaggtattccgtatgcccgttaatatcaaggctgttcatatacgtactgcgaataaaagaagtggattctgaaattccgtattcactgcacgcctgtctttcaaaacgcattaacagtttcagcattgatttttcgtcaaagtctatcttctgaatatcaccatcgggcatattaacgatgacacagttgctacctgtcttacgtttcatcctctccagtgcagcaattgcaatacgacgacggtaaatttcaattgtgttgtttttcacggcgtttctcctcttcgtccatccagacagaaatacctgatgagatattgagggcaagacccagaagtctcacagtctggagagggggcatttttttaaagctgatgtacattagatccagtagttcattaagacttctggcggagatcgccgcgtcttcaatgttgtcattttcttccgggttccacatatttacctcccgtatgctttgcgtaaaaacaattctgcgataatgttgtagccggaggtatgaaagagttgggctgttttaaacgcagcctggtctttgatgaaagtcatgattaactctctcgtaaattcaggttatagatatccctgccgtttaaggcactgttaatttatttagtccggttttattatttaattaaactattcagttttgtatctgcttctttaatcgattcttccacaccctcgatcagggtgatgatggctgatattaatgtcgcttcgtaatcatcccttgagctttcaaaccatgcagcaagcacagcttcagcctgtttaaccctgtttctggctgagattaaagatatagtcatttatcattccccctgtctgcctgctcttcgataagccatgcatgcacttcaccagataagcgacggattaaagtgattacagatgataattctgtttcgctcaacgtgtccggatagctttctaacattcgtaacagactttcgacctgacatgctttttcggttgcttgttctaaagaaatatcagccatgattgctaccttgtgcgcctgagagaaatgccgcgatctgagatattttattcgttgctattgctaattcagccagatccgaaataacactagagagttgtccgagcctttcttttttatcttcacagccaaaggtcaacgatgctatgttcaaactgatatggctaatcgcttcgagaagagaaatggtttttgaattgcagtcactagcgatattgccgtaatcaatatttgaacaatctccttcgaagcggaagtctttaatatctacgagctggatgaagtttttggtagttgctttgatagtcatgtcactggctccgttgtttgccgatgaaataagcatacgatcaccaaaaatgtctgtcaaacataaatatgtgttacagacatataataagattaagtttctgaattgtatagataataaatatgttttagatacaaaaaaagagccgtaaggctcttttaatatcagttgggttggcttaggcgtggcgtcgaatttgttgagattggctaagtaacaccttgccacaaacatgtaacatttccatttcttccttggtgatttgccactctttgtagagggggttatcagacagaacgagcaattggctcttgattttctgtaagcgtttaacgtacaggtccccgctaaaatcaaatacgtagataccgtcaccatcaaagtagttaacgccaatgtcaacaaaaattagatcaccaggctcaattgtaccttgcatactatcgcctcgaacgttgatgagttttacttggttggctggccgatgcccgaaaagagtttttgcctcttccgtcacgtactctatcgagctgattacttcgataaaatcacggctagaattaccattgcctgcacttgctgaaacatccataacatcgactcgatacacatcatttctcctctgatgtgagagtgaaagaacactgtatttatttacagtatcactatctgtttcagttgaaaatagctcagatacaggcacttggagagcttccgcaattttttgtatgctttgcgcactgtagccctgcatgcctcgctcaagtcgagaaatgtttcctacatcccagtcagtcaaagctgctaactgcgtaatagtcatttttcgggctttgcgtaattcacgaatcttttgtcccactttcacaaacatttctcccatgcagttctgcaatatgtattttatacataaatttgttacctacacaacttaccttgcaaattatgtttattgcacataatatgtgttaaaaacatagagggttatgcgcatgtttacgacaccactacgcaaagctcgactcaatgcaaagctgaccattcaggaggtcgcaacacaaaccaagtgcgacccgggcaatctcagccgcatggagcgaggtattcagcgtccatcaccggaactggctgaaaaactagccaagctgttttgtacggaattaacagaaattcagatcctttatccagagaggttctttcctgatggaaatgccaatcagaacactacaggaaatgcctgaaatttacgggcaagcagataaggactggattattcagcagttagaaagactaacaccagctgtacggcagaaagcggttctgcgttatgccgctgtctaccaggaagcctacgatgccgagcctgtttcataccgaaaggagaaccgggcaaggcatgaggcaaacacaaggcttcgcctgtttgtgagaaatcagggcagagctttacaggggtatacaactcagccgcccctggcaggaactaattcacgttcctgattggtaccgggcttaaaggttcccggtggctgaatctcaaatctcattgcatttgtgtactagttaagtggtacgtacaggattcaatgagaggaggggagggggaggagtgcccgtgtgttagtgcgaagcactggaacaggcttttccaacagtcaggtacataggttaagtagatctctgtaatagggcagaaataaaaaaatgcccgtatcgttaaactagtacaaagagggaaagatgaacacagatctgaagcaaaacttaatcgctctcctggaagagcaattcatccgctccgatgacaaagttgttttcgattatgtgatgcagaaaaaaatcaagtctcagggataccacctgcaacgcaatttcagcatcagcattagcggtggtcgtaaaggctttattgattgcctggttgcatcacctgacggccaacagtgtgccatcgaagttgacaaacgcacacctcgcagccgctcgctgttgaaacttagcgaactgcctgaagggatatctggtttcgttcttctcaaagacggtaagcatcctttgcgttatagcgaaggcggcatcgacgttatccgggcgacgaaatttaagtgaattgaattagaagggtggctggcagcttttggggaggccaccagccatgtgagggggaatccatgaaaaccacatcacaaaatcattatcgcatcgatatgggggctggacaatgctgaccatcacgccaaattttgcccaggaacgcgcgctgaacatgctgcgccgcgactggaagtcgcataatacttttatggtgtatgcacccactggcagcggcaaaacggggttagcagcgtttatcgttgacggtttcgtcagtcgcggaatgcgggtgatgttctgcgtgccctaccagatactgatcacccagaccgccagccgtttcattgagtacggattatcgggtgacgaaatcgggtacgtatgggccagtcatccgaaccataatccggcgctgaaaatccagatagccagcgctgacacgcttattcgtcgtgaatttcccgacaatatcgacctgttgatcatcgacgaagcacatctgcgcaaaaagcgtattttgcaggacattgagcgtctgcgcgccagcggagtaaaagtaattggcctgtcgggtacaccgttttcaccgtttctgggcaaatactatgaccgactgattaagccgaccaccatcggcgagttaatccagcgcggcgatctgagtaaatacgaattttacgctccgacaaagccggatttgaaaggcgtaaaaaccaagtcttcgcttgagtacggcagcgattacaacgaagcgcagctggctgaaatcatgtgcggatctacgctggtgggcgacatcgtacagaactggctggagaatggccgggatctgcctaccatcgctttctgcgtcaacgtagcccacgccaattacctgacaatccagtttaacctggcgggtattaatgctgaggtcatgactgccgacactccagtggatgagcgtcagaccatcattcaccgctttgaaaccggtgcaacgaaaatcatcgtcagcgtgggcgtgctggttgccggattcgacagtgacgttcgctgtatcatctacgcaagaccaaccaaaagcgaaattcgctggctgcaggcgatcggccgcggtcttcgcaccgcaccgggtaaagaatcctgcctcatctttgatcacagcggcactgtgcaccgtctgggttatccggattcaatcgaatatgacgatcttcccggcaagtctgacggcatggaggaaagcgcgcgccgctccagtcaggaacgggccgaaaaactcccgcgcgaatgctcacaatgtcattacatgaaacccgctggtgtgtacgtctgcccgaaatgcggacataagccgctggcaggtgaagacgtcgacaccgacacagggcgtaaactcaaaaagctgggtaaaaatcagcatcgacccacaaaggcacagaaacaagcctggtggagtcagatcaaattttatcagcgccagcgcgtatctcaggggaaaaggcccgtcagtgatggctggtgcgcacacaccttccgggaaaaattcggtgaatggccgaatgacctgagtgacttcccgatggaaattaccccggaggtaagcaactacatcagacacaaacttatcagatatgcaaaaggaaaggggaaggcggccgcacctgctgaaactgccagccccattcccgactcagacattacccacaaggtaataagtgcaaaacgccaggtagagaatattcgcagtatgcttgggagaagaacagcgtgaaaacagcagaagcggcgaaaggccgctggcctgaaattttagagcacttcgacctgccgccgataaccggaaaaaatcactacaggggcgaatgccctgtatgcggtgcacgtggcaagttccgcattgacgaccgcgacggtgccgggacatggatctgtgtatgtggtagtggcgatggcatgaaacttgtcaccctgacacaggggaagccatttaacgagatttgtaccgaaatagaccgtctgatcggaaatgattaccagcgggtgaaaatcccggtaaacagcagcgccaccagcttacgcaagcgtgtgttgagcaagttctctaagctggaggcactgcgtggcacatccggtgctgcgtatctcaattctcgtggaatatttaaccttcctgctgaggcgatccggttcaatgccaggcagagacacaacgggtgtgtattccagtctctttattcccttgctactgacgataaaggggagttgtgctatctgcatcagaccctgcttgatggtgccaaaaaagcagacatcggtagcagttcaaagcgcctcaaatccctgcaggaagataactatctggatcacgctcgttcagtagctatccgcatgtttcctgtcgccagcactctgggtatcgccgaaggcatcgaaacggcgctgtcagcgcaccagatttataaagtgaacacctgggcaaccattaacagcggctttatgaaaaagtttcgcgtaccagcaggagttctgcacctgattatttttgccgaccgcgacgagaacagcgccaccgggctggctgcggcttacgaatgcgctcatgccaatctgatggcaaagaacgatctgcagcgcgtcagtgtgtactggcctgatcacggtgatttcaacaatatgctcatgaatggcgatcaggttcgtgagctggttttccacaagaaaaaggtggctgcgtaatgcgtacagataacaacgaacataaagcactattcaccatcccgacggcagcgcacagctccgccctggtaaacgtcaaacctctgcctgagcaacgtagaatcaccgggcataaacagaccgacgcctatctgtgggtactggaggttatccacctgaatgaacctgcacatctggacgctgcagaagctgcgctggagaaaattaaaatctctccaaaagaggccggggaacggtattcccgttatctgctggcgaatggctgcgatcctttccagatagctttcggcaccatcggcatgaataaccccgcgaacgctattaaatcagcgcgggagaatatcaaaaaggcctctgaagtgcgcgctacgttcggcagctatgaatctgcaatggaggatgttgaggccgagcgagttattaagtcttctgcaaaattcattgatgattatgactggggatggactacggaggaactcgaagccggtcatattgacggcggccgcatgtttgaaattgatgaacagcgccgcgttatggtagacggctaccgtgacgtattgcctgagccccatacgctgtcagatgtggttcgtgaatttatttactgggactggctttatcaggttcgtcacactgcaggcagggaactcggtcacggatatggttattcggaacatcataaatcagtgtgtgaccgtgagcgttatctcgaaaaattgctggcaacaatcaaacctttgtcgcgtgctgaagccgtagaggtgtgccgctggtttctggcaagcggaaaggatgaatatatggaagacaaaggcgcggcggttattcttaatctggttggagagtgtgaagaatgaaactggaagcatcgctaaaacacttcagccctcaggggatgcacatcagcgacagtgtgaaagagacatcgccggatcggcttacaggtaccgatataatggtcgctattggtaccaccagcagccgtgcgcgcttcggcctggctgctttcttcggaaaggccgggatcagcaaaacggatgagcaactggcggttcaggcgctggtgcgtcacgcgatggatactgcaccgaagaacgtgcgcaaagctgcaggtggtgaatttggctggtgtatgctggtactggcgcagtttgcctttgctgagtattcccgttcggcagctaccagcgtgacatgtcacacctgcaaaggcagtgggcgaattacccgaacgcagacaacccgcaaagtgtcttacccgtgggggaaagcgccatactgggccagtaagtcccgcgctgtccgcccgtccgactgggagaaatggacggaggtaacggagatagtgccggcagtctgtgaagcttgcgacggtaagggaacaataagcgcccggtgccgttgcggtggtaaaggtgaagtgctcgaccgcattgcgacaaaagaaagaggtgtgccggtgttcaaaacctgtgaacgttgtagtggcgagggttattccagagtgtcttctgcgaccgttcatcgcgctatccttaaacgtcttccggatctccaccaatcatcctggtctcgcaactggaagccattctatgaaatgctggttgatgtattgtacaaaggagagcgtcaggccgcatcagaatttgagaaggcaacagcttattgatgtaatcggaacaaatggcgacaagtttttgcacgataaggttgactttgcataaacttgtcctgtatgcttctaatcatgcagagttacgcctgttgattattaattctaaatcacccgccaccgtgcgggttttttatgattaatcttgtattcatgtttctttaagcttgttacgtttgtgtgggtgttcaatccatagaatgctaatgtcagaatgatttttataaaatgtttttgctatttcataggcgcagtaattgagtgaatcaaaagcatcctccccacttgaatgcatatataaagacagggcgttattgttaatagcataatgtagccatactccaccgtagtaccagcacgtgatatctttataatcgacagtattggttcccttgtttttattcttgtcattcagccattgtagaagtgttttttctgtattcagatttgtatctgaagtgataacagcttccagaaggacatcatcctggcatgtacgtctcctgtactcccaactatgactgattttatagtatcctggcatttttgttctcctgatagcgatgcagtgtaattttttacttgctgccgataaaaaatcccgctcaagaaaagtaagcggtcagtaaatactgaaggtaaaggggccttgctcctgccgttacacaggtaaacaccagcccatcagcagaaacctgcaagaaactgactggtggcaaccgtgaaacatctcacaatttatatgccattactgtcaggtatgagcagataattcttaaaatgataaaccagctaaattatcatgttatgttactgctgctacagtgaatccccctgtgcggtggggtgtaattggttatcaatggaaacagctgtttgtttgccacacgagtcacggtatagccagccaaagattcaccgggaggcacccggcactgcagcatactgataacaaatatagcgtgtcccaaaggctcacttcggtgagccttttttacaggcgaaaaaaagcccgctacagagagcgggcacctgtatcgtcgcaaaataatgccaaagagatataaggttctacaaatgttcccgtaaagaacatagccttaatcaaaacttatgtaaacttctatccgtagtgcagtagaccttcttgtttcttagagcgtggaggatgtctgctgttaaagttatactttagtaaaccaataaaaacacagttatggcgaatccccctgagcggcggggcgaccagtcaaatatatgttcctcgcgaaccatgtcgactggtatgtggttcaccgggaggcacccggcaccgtaacaaccgaccgccactggctcacccggacagatttctaagctgtaggtacgaggtccgatttccgctgaccgctccagtaaaagtttttcagtatgagatgatgggattaccatagtgactgaaagcggcctgagtttgcatgagtgctggcttattgaatcagtgtaattttctgaaaatgatgctgacaggctcttcgccatataaaagcctgtatagtatcaccgcttataacagtggaaatatgtgttgaatatcagaacactattttgtcagtattagtatgtggatgagagtgtttgtgatacaggagttgaacatgaaatcggttataatggctttgtttctggttccggggttattcatggcatctgctgttgcaaaacaaccagagtccgcagcggtttactcacccgggcggggcgtattatgtgatcagtatttttgcgctgactcaacaggtatttcgtttgttctgacaaagcactatgcaggttctgttcagttaaaaaaactgaaatctatgggggattttgatcgtacagcatttactttttcaaatggcattttttgtgatgtaaaagaaagattatgtcgacaggaccgttactttggcaatgatggtaagcgcagtggcgttgtcaatcagcacttcaccaaaattctatttggaagtaagtgatgtttataaaatgatattttgaatgggcgctgtttttttgcaaaatttttgtgaaaaaatactgacctttgggctcaacgctcattcaaaatttacctgatacttcgtgtagctccgctggtaacgcggcggtggtccatcgttacagggcaaatttcaggcgaaaaaaaacgccaagggaagtggcgggcagtaaatactgaatttgaaaaaaagctacttcatcatcattagcaggggagtctgaacacttgacctggttatgcagacatcaacaccttgcctgacttcatcggttaagttaaacggataaatctcaaataaaccatgtaaaccacagtgttattatgcaggtgttgcggtgaatcccgttagcacggggcaaattgatcatctacttttgttaatcaacgttgcagcagacatgagcgccgcgagtcatggctgatcaaccaaaggctcaccgggtagcgatcggcactgcagcacctactctacccattacttaaatcaaaggctacttcggtagccttttctttttccactcacccgatacccgggtaattagtctcccggacagggggaggtcatgaaaatgcactttgatccccattcgtgggacagttggatcgaactttttcaaagctggtggcggggagacgtacccattggcggcgttgttatggcaatcgttgttgcgtttttccgcatggtctataacggcagcagctggaaagaaacgctgtttgaagggttgctgtgtggttccctgaccctgacggcggtttctgcgctggattattttgatgtgccgaaaagtctgacaatagccattggcggcactatcggatttatcggcgtgaagaaaatcagcaccatcatttcaacgtatttcagtaaccgctttggcggtggcaaccccccacaggtttaatcatgaatgagttacaatttcagcaggcggctggtatcagcgccgggctttctgcgcgctggtttccacacattgatgcggcaatgagcgaattcggtattactgcgccactggatcaggccatgtttattgcacaaacgggacatgaatcagcaggatttactgttctgagggaaagcttcaattattcggtggaggcgctgaagaagacgtttggtaaacgcctgacgccgtatcagtgcgaaatgctggggcgtattgatggtcgccaggttgcccaccagccacaaatagccaatctggtttacggtggccgcatgggtaacaaagacgccggagatggctggaagtatcgcgggcgtgggcttatccagattaccggactggagaattacaccagatgtggcgttgccctgaaactggatctggtggcgaatccgggacagcttgaactggaacgtcatgccgcccgatccgcagcgtggttttttgtgactaaagggtgtctgaaatattccggcgacctggtacgtgttacgcagatcatcaacggagggcagaacggcttcggcgatcggcgggagcgctttgagaaagcaaaatcggtgctggtatgaatctgttacctgtattgctgaaaaaatactggttgcaactctcagtgactttgctgattgctgcacttgcatggacaacagagcattaccgcgacaacgccattcagtataaatcgcagcgcgataccgccagccatcgcctgacgctggcgaacgcgacaattaccgacatgacgaagcgccagcgtgacattgccgccctcgatgccagatatacaaaggaactcgctgatgcgaaagctgagaatgatgctttgcgcgatgatgtcgccgctggccgtcgtcgcctgctcgtcaacgccacctgtcccgcaatgccgacaggtaaatccacctccgccgcccgcgtggataatgcagcccgccccagactggcagactccgctcaacgggattatttcaccctcaaagagcgagtgacaacaatgcaaaagcaactggaaggggcacaggactatatccggacacaatgtttgaagtgaggactaaaatggaagaagccagaattctggtaattatcatgttcctttgtggtctggtgttagggttcgcgtttgggatgatgtgcaaccgggataaccagatataaaaaatccccgcagttaaaacgcagattagatccacgctggatcagcagattgacgctgccgtcgataccgcgctgaccgatatcctcggtagtgatgctgataatacggttacgcagtaggtgagatcaggcattacagcagcccttcagtgaggggctgcgataatatcttatgaaggttagattacaggataaaaattaggtcgaagtaataaccccctttcattgtaatttttccttcagcgtataaatcacaaagagaatcgaatgtttcttcttgatcatcgtctttagggaaccatgaaggctggaaagctcttttccctctttcgtgcataattttttccatgtaaggaataatattctgttttttcattttcaaagcctttgattttaagcgcagagtctggcgctggtttacattaaccaaagttacgtctcgttaagacgtttacgaaaaaataatcccctgtaccactggcacgtaaatcaaattaatagtaactattctcatttgtaaaaaggtactcctggatgataggtcttccacggggcggcagcggcgcgggatttggcgcatttttgatttttcatgcatcatcatcatgttgtaactcattgttttaatatcttttatttttaaaagatgatgatttgtatgtttattgttcatcatcttcggcttttccgggggagggcgcgctaagaaacagccccagaggtaaaaatggacggcgaactgaagaacctcaaatgcaatatcagtcagcttgccgctattacggggttacatcgccagacggttgtcagtcgtctctcgggcgttcccctggcaccgggaagcaatgaaaaaaataagctgtatctcctgaccgatgtgatccgtgtactgatggaagcgcccgtttctcaggctgctgaacatcaggatccgaataaaatgactccaaaagagcgtaaggactggtttgactccgaaaaggggcgtctctggctggaaaaagagatgaagcaggtcgtcccgttgccggaagtccgtcaacaaatggcggcgatagtcaaggccattacgcaggtacttgaagtctggccggataaactggaaagggataagggatggtctgcggatcagctaaacgaggcccaggatgtggtggatgaggtcagaatactgttagttaaggcaatacaggagaccgcagacgatgacggggaataaatatggctctgcagcggcagtacgccgggaggttgctgaatatctcaggcctccacgcagaatgccggtagcggaaggaataaaacaatttatgtttgttccccgcggcgccaatacggcggttccctgggatgacacgttaacgccctacatgaatgaagcgataaatacactgtcaaaacgggaatatgacgcagtgatctttgccgggcccgcgcgaacaggtaaaaccctcgggctgattgacgggtggattgtttacggtattgtctgcgatccggcggatatgctggtggtccagatgaccgaaaccaaagcccgcgagcactccaaaacccgtctggcgcgtacttttcaccacagcccggaagtcagaaagcggctcagtccttcccgaaatgacaacaacgtccacgataaaatgtttcgtgatggttcattcctgaaaattggctggccgtccataaccgttttttcttcgtcggattacaagcgggtggcgctgaccgactatgaccgttttcctgaaaatatcgatggcgagggagatggtttttccctggcatccaaacgtaccaccacctttatgtctgcggggatgacactggcagagagttcgcctggtcgggaaatcaccgatgtgaaatggcgccgttcctcgccgcatgaggccccgcccacgaccggcattctttctttatataaccgcggtgatcgccggcggtggtactggccctgcccgcactgcggcgactggttccagcccgcgatggaaaacatggtgggttaccgggataacccggacctgatggccgccagcgaggccgcgcgtattcagtgcccgcattgtcgggcattaattcagccggaacagaaacgcgggctgaataaccgcggcgtctggctgaaagaggggcagttcatcaataaagatggcgagatcagcggggaggcacggcgctcacgtatcgcaagtttctggatggagggaccagctgcggcgtatcagacgtggcagcagctggtctataaactgctgaccgcggaagaagaatatgagcgcaccggcagtgaagaaacgctgaaggccgttattaatacagactggggactgccttacctcccgcgcatatccctcgatcaacgtaaagccgaaacgctgatagcccgcgcagaaaaacttcccccgcggcgggtgcccgacggtgtccgtttccttgtcgctactgttgacgttcagggcggtaaaaagcgccgtttcgtcgtgcaggtggtcggttatggcagtcatggtgagcgctggattgtggaccgtttcaatatcacccggtcactacgctgtgatgagagcggcgaggccatgcagataaaccccggcgcgtatcccgaagactggcatttactgattacggatgtcctcgaaagggcctggcctctggtcggacatcctgagcaggaaatgagtgtgttatgcatgggggtggactccggcggggaggatggcgtcacggataacgcgtatgcgttctggcgccactgccggcgggaagggcttgccggtcgggtgtatctctttaagggggacagtaccgcgcggtcaaaaatattctccaaaagctatcccaacaataccgggcgcagtgaccgacaggcccgcgcctgcggcgaagttccgctctatctcctgcagaccaatgcgcttaaagaccggatcgcctccgccctcgaccgtaaagagccgggggcaaactacgtgcatattcctgactggctgggtgactggttttttgaagaactgacctacgaagagcgcggcatggatggcaggtgggcgaagcctggcaaaggcgcaaacgaggcgctggatttactctgctatgcccatgccctggtaatgatccgcggctatgaacgtatcaactgggataatccgccgccctgggcgcgcctgcctgagtctgcacaatccagccgcaacacatcagcagcagtcgaccctgaaccagtgacgaatgagagtgaaaatcacgaaatgacagaacaacataacccggcaatgccgtttggcggcgtgtccggcggaggctggttatgacccgggaacagttactgcaactgcagcaggcttattttgacgcggagcttgccgtgcttcaggggaaatccatcaccctgaacggacagtcaatgacgatggaaagcctcggggatattcgccgggggcgaaaggagattgaggatcgcctgcggcttatggactgcgatcgacaactctattcactggcgaggttcacatgaattttctggataaagcgattggcgcgctggctccggggtggggcgcgtcccgcctgcgttcccggatggctatccgggcgtatgaagccatcacgcccacgcgtacccacagggtgaagcgtgaaaatcgaagtggagaccagcttatccagctggccggaaagtcgttgcgggagcaggcccggtggtttgacaacaaccacgacctggtgattggtgcgctggacaaaatggaagaacgcattatcggcgcgaaggggatcatcgttgaaccgcagcccctgacggggaccggtacgctgaactctgtgctggcagaaaaaatccgccggtgctgggctgaatggtctgtttcgccggaggtgaccgggcagtacacccgtcccgttctggaaaggctgatgctgcgcacctggctgcgtgacggggaggtgttcactcaggtgctgaccggaaaaatcagcgggctgtctcctgtggcgggggtgcctttctggcttgaggcgctggagccggactatatcccgctggagaggaccgacaacaacagcaacctggtacaggggatttatttcaacgagtggcggcgtccggtgaaatatctggtctgccagtcctggccgggagcgggcgctgcggcagtcgccgttaaagaggtgactgcggaaaatatgctgcacctgcgctttacccgccgtcttaatcaggcgcgcggcgcttctcttcttgcccccgtcatcattcgtctgatggacctgaaagagtacgaggacagcgagcgcatcgcggcgcggattgccgcgtcgctcggcatgttcatcaaaaagcaggatgtcggcactgacggctatgtggcgccggagaaacgtaaagagacacaaatccagcccggtatgttgtttgacggtctgaatcccggggaggatatcgggatgatcaaatcagaccgcccgaacgcgggtctggaatctttccggatggggcagcttcgtgcggtggccgccggactgcgcggcagcttctcttccattgccagaaactatgacggaacctacagcgcccagcgtcaggagctggtggaggcgcaggaggggtacagcatccttcaggacagctttattgctgcctttacccgtcctctctaccggcgctggctggctgctgcggtggcttccggtgccattgaggtgcctgccggcacggatatgtcctcgctgtttaatgcggtgtattccgggcctgtcatgccgtggattgacccgctcaaggaggcaaacgcctggcgggtgctgatacgtggcggggccgcaacagaaggtgactgggtgagggccagagggggcgcgcctgccgacgtgaaacgccgccgcaaggcggaaactgatgaaaaccgtaagctggggctggtgtttgacaccgatccggcgcatgaaaccggagagcaatccgatgttaaagaggaaaaaaaggaccctgaaaagtccacccagggcgatggcagccgcgcgcgggaagaacgaaagcggcgctgaatcctggtacaccatccgcgcggcggcggataacgcggccgatatcagtatttacgatgaaattggtggctggggaatttcggcgcactggtttgccgaagagctggtggccctggggagtatcacgcagatcaacctgcatattcattccccgggtggcagtattttcgacgggctggccatttacaatctgctgaaaaatcacccggcgagaaaagtggtgtatgtggacggtgtggcctgttcgatggcgtcggtcatcgcgatggtgggcgaccccgtcatcatgccggaaaacgcgatgatgatgatccaccgcccacgcggtattgccggcggtgagtcctctgatattcgcgactatgccgatctgctcgacaagatggaaagcgtcatcatcccgatttacgccgaaaaaacggggaagtcaccggacgatattgccgcgctgctcgccagtgagacctggatgagcggggccgagtgtgtccgggaaggctttgccgacaaagttattcagcccgtccgggcaatggctcatctgcattcaaaacgacttgaggaatttgaacatatgccacagaacgtcaaaaacatgattattgccccccagggtaacgccgggacactgacgcagccggagccggagccgcaggccatcatgaccacgccgccggtggcggtcaccacaccgtcgccacaacctgctaccactgctccggggacggatgaaatcaccctgcgcgcccgttttcaggaagagcagcgacagcgtatcagcgggatccagaatgtgtttggtatgttcggtaaccgccacggcgagctgatggcgcagtgcattgcggatgtggactgcaatgtggacgcggcaaaagacaaactgctggaggcgctgggccggggggtgacccccaccaacacgctgggcgggacgcagaacacacaaaatccgatgctctcccatatctatgcggggaacggtaactttgccggggatggcatccgggcttccctgatggcgcgggcggggtttgaaagcagccaggcggataacccgtataacgccatgaccatgcgggaactggcgcgcatgtcactgaccgaacgtggcgtgggtgtctcgacgctgaacccgatgcagatggtcgggatggcgttcacgcacagcacctcagattttggcaacattctgctggatgtggcgaacaaggccattctgcagggatgggaggaagccccggaaacctacgaactgtggacgcgcaaaggccagctttctgacttcaaaaccgcacaccgtgtggggatggggggctttaattccctgcgtcaggtgcgcgagggggcagaatataagtacgtcaccaccggggacaaacaggccaccattgcgctggcaacctacggggaactgttcagcatcacccgtcaggccatcattaacgacgacctgaacatgctgaccgatgtcccgatgaagctggggcgggcagcgaagtccaccattgccgatctggtttatgccatcctgacctccaacccgaaaatgtccacggacaacgtgaacctgttcgataaggcgaaacacgcgaatgtgctggaaggggcgctgatggatgtggcatcgctggataaagcccgccagctgatgcgtacccagaaagaaggtgagcgtcacctgaatattcgcccggcattcgtgctggtgccgacagcactggagtccgtcactaaccaggtgatcaaatccacgagcgtgaaaggcgcggatattaatgccggcattattaacccggtgaaagattttgcgaccgtcatcgccgagccacgccttgatgataacagccagtccactttttatctggctgccgccaaaggcactgacaccattgaggtggcctatctcaacggcgtggatacgccgtatatcgatcagcaggacggtttcagcgtcgacggcgtgactaccaaagtacgtatcgatgccggggtggccccggtcgatcaccgcggcctggtgaaatgttccgcataaatgtcacagacaactatccgaatggcccgtcagggctttttttacgtctgaaatccggccattcgtgaccggaacggagaaaatcattatggcaaagaattatgtacaggcgggcaccacgctcgccattacggccaccgctgcagtaaagagtggcagcctggtgcaggccggcgatgtgttcgtcgtcgctgtcaccgatattgcggcaggcgccaccggggacggcatcgcccacggcgttttcctggtccccaaactggccaccgatgtgatggcggcgggaaaaaaagtgtatctgaaagacggtaaggtacagctggatgccaccggcggactgccgctggtgggcgtgacctgggcgccggcggcaaaaggggaggaatctgtgccggtacggctcaatggctaatccctttgaccgcctgagcaccaggatggacgaggtgacggctgcccgcttcgggcggcctgtcctgattgacggggcggagtatgttgctgcggaggccacgtttatggcggaactgggtgcgctttccggggaggggacacacctgattgtgttcagcccacagtacaggcccgccagaaagcaggccgtgctctggcgtggactggattttactgtcacccgctggcagcgcgtcaacggaaaataccagatttcactggagtgaatcatgtctctgaaggggctcgaaaatgccattcgtaacctgaacagtctggacaggcatatggtgccgcaggccagcgcctgggcagtcaaccgcgtggcggcctcggcggtgtccgccgccacgcaccgtgtggcgaaagaggctgtggcgggagataaccagaaaaaagggatccctttccggctggtgaaacagcgcgtcagactctggaaggcgagcgcaacgggaaaacactatgcccgtatccgggttaaccgcggcaacctgcccgccatcaaactcggcagtgcacaggtcaggctgtcccggcgcggcgggaaactcctgcgtcgtggcagcgtactgaaaatcggcccgtatctgttccgggatgcctttattcagcaactggcgaacggtcgctggcatgttatgcgacgcgtgaacggcaaaagccgctacccgattgatgtcgtcaagatcccgctggttgccccgctgacgcaggcgtttgaaacggagaaaaaacgtatgctggagcaggagatgccaaaacaactgatgtatgcgctgaaacaacaactgaggctgtatctgacccgatgaacaaacacacccagattcgccacgccgtgctggcgaaacttgaatccctgtctggatcgtccgccatgctgcacgacggtttgccggtctttattgaaccagaagagcttcccgcactggctgtctggttgaccgatgcgcagttcgccgggcagatgcttgatgaacgcgactgggaggccgttctccatgtggcggtatttctgaaagcgcaggccccggatgcggaacttgatatgtggatggaagagaaaatattccccgcactggaagaggtcagaggcctggaaaaccttatcaatacgatgacgccgctgggttatgactaccagcgcgacagtgaaatggcaacgtggggcatggcagaaatcacgtaccggatcacctacaccaactgaggatactgttatgggcgtacccaacccactgataaaaaccaaaggcgccgggaccacgttctggctgtacaccggacgtggcgacgcgtttcacaacccgctggctgatgacgactggcttcgcctggcaggtattaaagatctgcagccgggtgaaatgactgccgatgcggaagatgatgattatcttgatgatgaagatgctgactggaaaagtaccacgcaggggcagaaaagtgtcggtgataccacggcaacactggcctggaaaccgggtgaaaccggacagaagacgctggtggatctgtttgactccggcgaggtccgtgcctttcgcatcaaataccccaatggtaccgtcgatatctttcgcggctggctgagttcactcggtaaaaccattaccgccaaagaagtgatgacgcgcactgtgaaaatcagtggtgtcgggcgtcccttcctggctgaagaagatgcgccgtccgtgatcagtgtttccggggtgaccgtggcgccgttaaatgcgtcggtggctgtcggggccaccaccacgctgacttttaccctcaaaccggatgatgccacggacaaatccctgcgtatcgcatcatccgataccacgcttgccaccgtcacgcaaaaggacaatgtggccaccgtgaaaggggtgaaagcgggcagcgtgactgtcgttggtatcaccacggacggcagcctggtcgctgtggctccggtcacggtcactgccccttaattttcttattcctgccccggctccggggctttgcgggaaaaatcatgtttctgaaaaccgatacctttacatacggtggtcattccgccgtgctcagtgaattgtctgccctgcagcgggtggattacctgatgtttatccagagccgcaccgcggaatatgacgccctgccggagacgctgacggaacaggagcggcaggccgcgtttatgcaaatgggtgtggatatcaatgcctggctggtgtcccgctcgctgtgcgaaagcaaaaaggaagacgacgcccgtcatttatatgacgcggtccgtgcgcagtggtcttttgacgcgctgggactggcagcggataaggtcctgatgctcagcgggatggttgttcctgttgcggatgatgccagtgaggatgacgatacttctgagcaggacgcgctgacaccggaaaagccctgacccgggagctggcatttgtgatgcaactggcgcgggagttccgccgtccggactggcggcggatgctgtcagaaatgaccgcgtcagagctgggcgagtgggcggatcacttcgtccgcttcagtttcagcgatgccctgctcgatgcggagtttgcgacgctgaaagcgctggtgaccgggctggtgacaggtgaagcgcaggatgcggacgattttcgtctgttaagtgcatctgaatctgctccggagaaaactgatgaagaactgatgcgcctgggtgagggtataaccggaggtgtccgttatggaccagatagcgaacctggtcattgatttaagtgtcgatgccgcagactttaaaaatgaagtgccccgcgttaaaaaactgctggatgaagtctcgggtaaaaccgacctcgtcacgcagcggcaaaaaaatcttattgagaccctgaaaagtcaggggcgggcatatgtggacgggagcatcgctgcgtctgatgccggcacgcgccagaaacaggcgatggtcatggcggcgcagggatatgaccaggtggctcagcgtgtcgatatgacgcagcgtcatgttgccgcactgagtcagaaaatgcaggaagagcgtgctcaggccgccgcggtagcagcagcccaggaccaggcgagtgcggcattttaccgtcagatcgacagcgtcaaatcgctggagaatggcctgcagcagctgcagcgtatccagacgcaaatccgccaggcgagaaacagcggtggtattgcgcagcaggattatctggcgctgacttcagaggtggcagcaaaaacccggaccctgacggatgcggaggccgccgccactaaacaaaaagtccggtttatccagcgtctcaaagagcaggtaaccagccagcgactctcgtccaccgaaatattgcgggtgaaagccgcgcagctgggcgtgagcagtgcggcggatatttatatccgccagatggaaaacgcaggaacggtgactcgctcattgggactgaaaagcgcagcagcacgcagagaaattggtgtacttttcggtgagcttgcccggggaaactttggtgcattgcgggggagcggcatcaccctcgccaaccgcgccgggtggcttgaaacgctgatgtcgcccaaaggactggcagtgggtggcactgtcacggcgattgccgctgctgtctatggtctgggaaaagcctggtattcgggaacgaaggaaggggaagagtttaacaaacagctgatcctgaccgggaattatgccgggaaaactgccgggcagttgcagcagatggcccggagtattgccgggaacggcatcacacagcatgatgctgccgggatactggcgcaggtggtgggcagcggcgcgttcggcagtactgacctttcccgggtggcgaatgccgctgcccgtctgaaacaggcgaccgggcaggacatcagcgaaaccatcagccagtttaaaaaactgaaagatgacccggtaaatgccgtggtggcgctgaatgactccctgcatttcctgactgccacgcagtaccagcagatttctgccgcgcaggcggtgggagattcgcagctggcggcggcgctggccatacaggcatactctgacgccgttatgcagcggacaggcgccgtacaggataatctcggctcgctggaaaaggcctggaactgggtgagaaatgcggctgtcggtgcgtgggatgccatgctgggcgtcgggcgcagtcctgacaccgccatgaaacgccaggatatgtttgcacagtggcaggcggcggaaaaagagtatcaggttctgtctcgtaatctgaaggtggatccggactacagtggcagtaatcccctgcagaaggcggatgctgaacgcctgaggaatgcccgccagagtctcgccctgaaaaaagcggcttatgatgaggcggataaagcgtatgcgcaggagggactggctgcagcaatggaaaagcagcgtacggatcaacaggcgcaggcgatacgcagccagcaggaatttaaccaactagtcaaaaacggtacctcgcaggcggaaaaacgtgcgcaggcggaacaggaactgaaccagcttattgcaaaaaaccgccgggacgcaaaagacggggtgaccgccctctggaccgagaaggatatttcatccgcccggacggggatagaaaaacgtttcaaagacccgacccccccaaaaaccgccgccacccgtaacgatgaggccagtcgtctcctgcttcggtacagccagcagcaggcgcaggtggaggggcaaattgcagcagcgaaacagtcatctggtttgaataccgacaggatgacggaagcgcacaaacagttactggctcttcagcagcgcatcagcgacctgtccggtaaaaagctgacggcggatgagaagagtgttctggctcataagactgaacttgttcaggcactgacattgctcgatttgaagcagcaggagctgcagcgtcagagtgcgctaaatgacctgaagaaaaaggcggttcagctggaaagtcagttaaaactggaagaacagtcgcagcgtcagcggcacgatcttgacctggcgactgccgggatgggggatgtgcagaagcaacgttatcaggagcaacttacccttcgccagaaatttgcgcagcagcaggaacaacttgaacgggacagccggcaaaaagggacctacggatcggcagagtacagcgaggcagagcaaaaactccgcgacagcctgaacgtgcagttgaatgaaaaccgccgttactggcagcagttgtccgttgagcagggcaactggaagaacggagccacccgggcatttcagaattacaccgcggatgctggcaatgcggcgggtgtggctgaacaactgttttcgtctgccttcagcagcatggggaacggcctggcgacattcgttaccaccggtaagctgagtttcaaatcctttactgcctctcttctttctgacctggcaaaaattatggcgcagatggcaatgatgcaggccgtgaaaggtgtgggaaatgcgctggggtttggtgtaacggcgaatgctgacgggggcgtttaccagtctgccagcctgagtcggtacagcggtagcgtggtgaacacaccgaccttctttgcgtttgcaaaaggggccggcgtgatgggggaggcagggccggaagcgatcctcccgcttaagcgcggtgctgacggaaagctgggggtggttgccgccggtatggggggaatggcgatgtttgcgccgcagtaccatatcgcgatcaacaatgatgccggtaacgggcagattggtcccggcgcactgaaagtggtttatgacctgggccggaaagcggcggcggactttatcgcacagcagggccgcgatggcggtcgtttaagtggagcttacagctgatggagacatttcactggaaaatacgcccggatatgacaatggaggccgaaccgcaggtcattgctgtgaagatgggggacggatatgagcagcgtcgcccggcaggcctcaatagcaacctggcgaaatacaatgtgaccataaaagtgcgcaaaggcgagcatcagcggctggatgctttcctctcccggcatggcgcggtgaagtctttcctttggacgccaccgtatacctggacgcaaatccgggtggtgagccggaaatggtcggtcagcgtcggggcgatgtgggtgacttacacgaccacgtttgaacaggttgtcgtttaggatatcaatatgttaagtattctccgtttagtatcggtttagttttattgaggaaccatagggctgtaaaggaatctatcagtctgcacaaaatgtgctttttaagtattttaaaaaggagttttcatgaagcaggttctcattgcagtgttgatagtatcagtaacaggtggtttggctcaggctgctggggtaaaaaatacagtatcgctgggttatgcgtataccgatcttggtggcgcgttgtccggtaatgcgagagggctgaatctgaaatataacgcggaagacctgaacagtggttttggtggtatgggatctttcacattcacaactgcagacattcaatcctactctggaggcaaggccggtgatatggattactcgtcttttcttgtggggccttcctatcgatttaatgaatatctgaatgcttatgtaatggcaggcctggggcatggtcatattgacgataagcgtgataactctggaaagaagaccggctttgcatacggtgcaggtgttcagatcaatcctgttgaaaatatcgctattaacgcttcctatgaatacagtcgattttccgcttatgactcgaaagttaacgcgggcacatgggtattgggtgtggggtatagtttctgattattattgcaatttaatattaatttttccgtactatgtaaaccctccgatgcgagggttttttgtaagctcctttggggcgtaatcaatgccacttgctatgcacgtggtttttttttacgggagaggtcatgcgggacattccacaggatacgctgagccaaaccacgaaaaccgagcagtcggcccgcattgatttgtgggaaatcgacctgacggccattggtggccagcgttactatttttcaaacgaactgaatgagaagggcgatccggttacctggcaggggcgtaagtatgacgcttacccgatacagggaaccggctttgagctgtcagggaaagggacatctgcacgaccaacgctggcggtgtcgaacctgtttggtatggtcacgggacttgcggaagatgtgcagagcctggtcgggggcacagtggtcaggcgtgtggtgtatgcccgttttcttgatgcggtgaattttacaggtggcaacccggaggccgatccggaacaggaagtggtcagccgctgggtgattgaacagctgtcggaactgaaaaaaaccacggcgaccttcgtgctggccacgccgaccgaaacggacggcagcgtgtttccggggcggaccatgctggccgatgtctgcaactggacctaccgctctgatgagtgcggttatgccgggccacccgtggcggatgagtttgacaagcccacagcagatccgtcgaaggacgcatgcagcaaatgccgtaccggctgcgagctgcgtgataacctgccgcgcatcggctgcttcctctctataaaccgcctttcctgacggagaacagtatggaaaagactatcctggtgcatgccgcagcgtgtgcaccggcagaatcgtgcggctatgtggtgaacacgtctgcaggggaacggtattttccctgccagaatctttccgctgaaccgacgatgtatttccggatggcgccggaagattatttgcgcgcgcaggcggcaggtgacgtggtggccctggtacacagccatcctgatggtctgccgtttctcagcgacgtcgatcgccgcctgcaggtgcaaagtggcctgccgtggtggctggtctgccatgaccggatatacacatttcgctgcgtgccgttcctcaccgggcgggtatttgagcacggtgtgacggactgttacaccctgttccgtgatgcgtaccatctggccggtattgagatgccggatttttcgcggggagaggactggtggaaaaacggcgagaacctgtatctggataatctggaggcgacaggtttttaccgggtgagtggtgaagaggcacagtccggagacattctgatttgttgttttggttcatcggttgccaatcatgccgcgatttactgtggcaacggcgaactgctgcaccatattcctgatcagctcagtaaacgcgagaggtataccgacaaatggcaacgccgcacacactcgatatggcgacaccgggcatggcacgagtctgccttcacggggatttacaacgatttggccgccgctttagcttcagtataaaaacgggggccgaggctatttacgcgctggccgtgcagataccgggcttccggcagaaaatgaacgagggctggtatcagatacgcatcgccggtcaggatgtggatgaaaccagcgtgtcagcccgtctgcatgagccgctgccggacggggccattattcatattgtcccgcgtattgcaggggctggaaaaggtggtctgttccaggtagtgctgggtgccgtggcaataggcgcgtcattttttacggccggcgcttcaatggctgcctggggggcggcgttatctgccggtgctatttcggcatcctcggtcctgttttctatgggggcggccatgatgctgggtggtgtggcgcagatgctgacgccgcaggcaaaaattccctcgtcccggcagaccgacaatggcaaacagaacacctggttttcgtcgctggacaacatggtggcccagggtaatgccctgcccgtgctgtacggcgaaatgctggttggctcccgcaccatttcacaggaaatcagcacccgggatgaaggtggcggcgggcaggtggtgatcatcggtcgataaaacgagccgccggtcatggacggcccgtggaacagtgcctcacagagtgaattttattttataacgccacaggcgattcgtgcaccaccgcccccaagcgggttgggatgatcttcatggttgtcaccgccggtatggatcatgatggcatggcctttgacctgactgattgatttgaggcgtggggccagaaccggataatcagcgttacctgcctgatttacatacagcgccggaagatcaccgagatgaccttcaggattatacggaccgagatgtttatttgtgtgctgagggtcaaggtgccctccggcagcaagtgctgcgacaggtttaccgtccttcatgccagcatcacagcttccgttctcgtggatatgaaacccatgaataccggctggaagtgaggacaaatgtggggtgaataacaagccatattctgtttcggtaattgtaatattgccgatcttttgacctgtgccattggcatttacaaggttaaccgttgcgtcggtacttgctgctgaggctgcactactgaataaaaatacagcaagtgtcattaactttttgttcatcttaactccattgttgtggttgtggtttttatcaggttgatagtaaagacattaaagtcaaattaattcgattgttgttattgctaatatctattgatgacaaaccgcctctgggcggttttgtcgtttcagagggaacagattatgggtaagggtggtggcagcagtaagacgccgcatgaggctcctgacgacctgaaatccagtcagatgctgaccgttgttgatgccatttgcgaggggccgatcgaaggcccggtggacgggctgaaaagtgtcagaataaacaaaaccccggtcctcgacagtgacggtaacgcgatggttcacggtgtcaccgtggtttaccgcgtgggcgaggatgagcagtctgcgatggaggggtttgaagattccggcgctgaaaccctgctgggtgtggaggtcaaaaagtcagagccggtgacccgcaccattaccaccaaaacggtggaccgcctgcgctttacctttggtgtgcagtcgctggtcagtaccagtaccaaaggcgaccgcaacccgaccagtgtacagatgctgatccagtttcgccgtgatggccagtggcaggtggaacgggatattaccattacgggtaaaacgaccacgcagtttctggcgtccgtggtgatcgatgatttgccgccccggccgtttgaagtccgcatgatgcgcatcactgatgacagtacgtcagacctgctgcagaacaaaacggtgtggtcgggctataccgaaatcattgatgtgaaacagtgctacccgaacaccgctgttatcggggtaaaagtggatgcggaacagtttggcagccagcaggtcacgcgaaactaccttctgcgcgggcgtattgtgccggtcccgtcgaattacgatccggtaaaacggacatatacgggaatatgggacgggacgtttaaacctgcctggacagataatccggcctggtgtgtgctggatatgctgactcacccgcgctatggcatgggaaaccgcattggtgttgccgatgtggacaagtgggcgctgtatgccattgcgcaatactgtgatcagcccgttccggacggcttcggcgggacagagccgcgcatcacctgcaatgcgtatctgacggaccagcgtaaagcgtgggacgtgctgggggatttctgttccctgatgcgctgcatgccagtgtggaacggcagtaccctgacgtttgtgcaggaccggcccagcgataaagtctggacctacacgcagagcaatgtggtgatgcccgctgatggagcgccattcgtctacagcttcagcgcgctgaaagagcgccataatgccgccgaggtccgctacaccgacccgaacaacggctgggaaacctccaccgaactggtggaaaatgacgctgccatccggcgctacgggcgcaacgtccttaaaatggatgcgttcgcctgtaccagtcgtgggcaggcgcaccgcgcaggactgtgggccatcaccaccgaattactggaaacgcagacggtggatttttccgtgggggcagaagggctgcgtcacgttcccggcgatatcatcgaggtctgtgacagtgattatgccggcgtgaccgttggcggacgcgtcctgtcagtcgacagcctttcccgtacgcttacgctggatcgtgaggtggatataccggcaggcggcaatgtggtgctgaacctggtgggcagtaatggccagcctgttaccgtcgcggtcaccgcgcaccccgccccggaccgcgttaccgtcagccagttacccgatggcgtggcggcgtacagcgtgtgggggctgaaattaccggacctgcgccagcgcctgtttcgctgcgtggctatacgggaaaacgatgacggaacgtatgccatcaccgctgtgcagcatgtcccggagaaagagagcatcgtggacaacggagcgaagtttgacccgttgcccggaaccagcatcacgaatacaccgcccgccgtgcagcatctcactacggagattctggcagaagagggacagtatcaggcgcgggcgcgctgggataccccgcgcgtggtgaagggggttaacttctccctgcgcctgacagtgaaagcggaagatgacagcgaccgcctggccagcagcctgaccctgaccgaaacggagcataccttccgcaacctgacgccggggcgctacaccctgtccgtcagggcggtgaacagccagggacaacagggagacccggccagcacacagttcagcatctccgcgccggcggcaccatcatttatcgaactcacccctggctatttccagattacagccacaccgcgtcaggcggtatacgacccgacggtgcagtatgagttctggttttcagacgcgcagattacggatatccatcaggtggaaaacgccgcacgatatctgggaacagcgctgtactggatagcggccagcgtgaatatcaggcccggcagggattactatttttatatccgggcggtaaatcgggtcggtaaatccgcattcgtggaggcgaccgggcaggccagcaacgatgccgcaggctatctggattttttcaaagggcagataactgaaagtcacctgggtaaggagctgctggaaaaagtagatctgacggaggataacgccagcaaactgcagcagttttcgaaggagtggcaggacgcgaacggtaagtggaatgccatgtggggcgtcaaaatagagcaaaccgaggacggcaggcattatgtggctggtctgggcctgagcatggaggatacgccggacgggaagataagccagtttctggtagcagcggaccgcattgcattcattaacccgcaaaacggaaaccagacgcccggattcgtcatgcagggtgatcagatattcatgaacgaggcattcctgaaatacctgagcgcgccgaccatcaccagtggcgggaatcctcctgcgttttccctgacgccggacggtcgtcttactgcgaaaaatgcggacatcagtgggcatattaatgctatttcgggggcgctgaataacgtcgttattgctgaggactgcacgattcaggggacgttgcgggccgaacgtatcctcggcgatatagtcaaagcggtgggtaaagagttcccgtatttcagggagccagccaccggagcaaagcgttacgccagtggcacactgaccgttcagatagatgacgaccagtcatttgaccgccagattattatcccccccatcaattttcaggggagttattacggacgcaatgatacgtgggatacgtgtacgctggaagtgcgccgcaatggcgcgctgatttacagcggaacgagcagcagcgttcctgagtcatacggcgccacgctggatatgcccgccggaggcggcattgtcacactgacatttagtgtcagtaccagggggaacagcacaggatggccgaattccagaataagcgatctgattctgatggttgttaaaaaatccactgcagggattcgtatcagttaaatcattaagagccgcgtaaagcggctttttttatggaggcaatatgccagtacttatttccggcgtactgaaagatggtacgggaatgccggtacagaactgcaccattcagctgaaggcctgccggaccagtacggcggtggtcgtgaatacggtggcatcggaaaatccggatgaagccgggcgttacagcatggatgtggagcaggggcagtacactgtcacactcctggtggaagggtatcccccttcacctgccggagttattacggtctacgttgattcaaaaccgggaaccctgaatgattttctgggggccatgacggaagacgacgtccgcccggaggctcttcggcgttttgaggcgatggtggaagaagttgcccgccaggcatcggaggcatcgcggaatgccaccgccgcagggcaggcatctgaacaggcgcagacatcagcaggtcaggcggcggaaagcgccacggcagcagctagtgcagccggagcggcagacgcatcagccacacaggcggcctcatccgcagcgtctgcggagagcagcgcaggtacggcgaccacaaaagccggggaggcatcagccagcgcggcgtcggctgacacagccagaacggcggcagccgcatcggaggccgcagcgaaaacatctgaagcgaatgcagatgcctcccgtactgccgccggagattcagctgctgccgcagccgccagcgcgacggcggcgcagacatcagcagagcgcgccggagcatccgaaaccgccgcgaagacgtcagaaacgcaggcggcttccagtgccggtgatgcaggtgcgtcagccactgcggcggcagcgtcggaaaaggcggcagccgcatcggcagccgaagcaaaaacatctgagacaaacgcagcaacgtcagcaagtacagcagcggccagcgcaacagccgcctcgtcatcagcatcggaggcatccacccacgccgccgcatctgataccagcgcatcactggcagcgcaaagcagagctgctgccggagaatcggcaaccagagccgaagaggccgcgaaacgggccgaagatattgcggacgtgatttccctggaagatgccagcctgacgaaaaaaggcatcgttcagttgagcagcgccacggacagtgacagcgaagcgctggcgtccacaccaaaagcggtaaaaaccgttatgggtgaggtacagaccaaagccccgctggacagtccggcgctgaccggtacgccaacggcaccaacgccggaaaccacagctgcaggtattgaaattgccacggcagcgtttgtggctgcgaaagtggcacagttggttggttctgcgccggaagcgctggacacgctgaaagaactggctgacgcgctgggtaacgatcctaattttgctaccacggtactgaataaactggcgggcaagcagccgctggacgatacactgacggcgctgtcaggaaaaagcgttgacggtcttatcgaatacattggtttaaggaacacaattgacaaggctgccggtgctttgcccgctggtggtacagctgttgcggcaaacagactggtgtcacgcggcgcacttccggcactgactggtacgacaagaggcagtgatagcggcctgataatgggcgaggtctacaacaatggctatccgacgcaatacggaaatattttacgtctgaccggaaccggtgatggggaaatcctcattggctggagcggggcaaacggtgcgccagcgcccgcatatattcgcagccatcgtgataccgccgacgctgagtggtccgaatgggcaatgctctacaccacactaaacccacctccggattcgcatccagtaggggcggcgattgcatggccatctgatgctactccggcaggttacgctctgatgcaggggcaatcgtttgataaatctgcttacccgttactggctatagcgtatccgtccggcgttattcctgacatgcgaggctggacaatcaaaggtaaacccgccagcggtcgcgcagtgttgtcacaggaaatggacggcaacaaatcgcactcgcacacggcgcgggcacaggataccgacttagggacaaaaaccacctcatcatttgattacggcacgaaatcgaccaatacaacgggcggccatacacatgagtttggcggttatatcaattcatactggggagactcaaatcacacctcatttcagcctggaggtggtgcgtggacacaggccgctggcgaccatgcgcatacagtttatatcggaggacacgagcacaccatgtatatcggcccacacggacacgtcgttattgtggacgcagatggtaatgcggaaaccacggttaaaaacattgcatttaactacatagtgaggctggcataatgccttttaaaatgagcagcaaagcgcagactattaaaattttcaatctgcgttcagatacaaacgaatttattggggcaggtgatgcgtatatcccgccgcacactggattaccggcaaactgtactgatatagcccctcctgatattccctccagtcatattgctgtatttgacgctgaaacccagacgtggaacctgaaagaagaccatcgcggagaaacggtatacgacacaacaaccggtaatcagatgtatatctccgaacccggcccgttgcccgaaaatgtcacatcagtttcaccaggtggtggatacaaaaaatgggatagtaaggctaaggcctgggtgaatgatgaaggtgcggaggttgcagccagacttcgtgaagctgaaggaaccaaaagccgtcttttgcaaatggcatcggggaaaattgcgccgcttcaggatgcggttgatcttggaattgcaacagatgatgaaaaagcgcagctcgacgaatggaaaaaatacagggtactggtaaaccgggttgatacctcaaatcctgattggccggaacaaccagtctgataaaaaatatagctatgtagtagagactgctgctatatgttatatagcagcaatggctattttttgatgtttaattgtatgattttattactggtaaatgacggctaaggtcctggaactcaatacttccattggcttcatagacaacatacagtgtttctttatctacatttttacgatatgaaagacaagagtaacccgccccactggcattaccgactttcggataaaaatcatcaattaactttacttccccggagtataaattgtgagcgtagagagatatatcacttctggtatagtcattattcttgttctgcgcggatgagtgagccgcgacaagtttattgcctgatggaatagtaattgttgaaccttgtactccatgattcctgttgtcaaccttcttgtccatcggaggaaactcagtccatgtttttccaaaatcttttgtttcaaaagaacggcggaggccagagtttctgatgttattaaccaaagaggcattaaattctatgatgttattttctgaaccaaaaccctcacagtatcctgatggcaatgaccatgttattccatcagtggagtatatgaatgatgtattcagaactgtggtgatatttttagtgcgaaccatttgtaccgggaaaaccagtttaccgtcatttagctgaagaccagatccaacaccgccaagcattgcagatatcgttccatttttagttactatatcatggatgttcgtttccacctttgaaaaggtaacgccatcatcggttgatttatataaaaccaaatcccagtcagtgtctggagccttatctctgtatgcgccccatgttttatcattattattccatttgccaaccatgactaagattgtttctcttccctgaatattcgccacgatgcatgtgggatccatgacgcgggaaagtttactgttgacacggtcattataaatcgcaatttttttattccaggttttccctccatctgtgctacgggccgccgctgtgtcaataaaggactgatcgctggcagtgttatggcgcgcatcagcaaatacaacaatggtaccttttgaggttgtacacattgctggaattcgaaaatatttggttgttcccccagagccgctaccgacaatagtgttgcctttttgatcagtaaaatgctcaccttcagctttaaaaaccacggatttttctacagtcatactctttccttccttaatgaatgggtgtgtatgcatatccagtggtggatgcatatacagtattctgcagttaagtagatgtctggtcaaacatatgattaccgttatttctgtttatgtgacgagtagcacagaagagtctttttgaggtaattcttatcaaaaagttagtacagtaattaaatgatgattaatcatttcatcaactcgttaaagaatcgaaccagcagttgaccattatttatgacgtgtggctgtcgacactgtacagaaatttcccggctaatttgagatattggggccaaccgtaaaaatgattccaccaaaaagatcgttaaagtccctaccgatagcttcgagctgacgtctccacgcgattgcaatggcactttgcatccttcggttagtgtaaaacaccacgcaacgctgtccgacgaaattgaacgcaaggttattcttctgttcgggcagggaagatactgatgctatttgcctctcctgtccatgtgctcatcagcaataacgagcaggataataattagtgccaaaataaaacaaactccagtcataataagcgcaaatctgtccatggttcgtactctaaaaaaactgggggtagactggtctgagataccgatatggatagatcatttgacagcccttttagcgtttaaatatatggcatatgacagtgtacagtatgatgccaaagatgatgataactactgtactaataagaataatccagtctgcctgcgtcatcattaaatccacctggattgttaaaaaatcccatccgcagttgcctggatgaggggtaaagttaaaaccacagtagtttaaggattgaaaacttattgtagctatcaaatgatattgtggtaagtaagtctctctacgttgaattgttgcagtataatagattacggggatatgtttgttttttttaaataaaaccgactgagtactgacaacaatttttttcgtttttgccttgcttttctcaggcataaacttcgacgtctggatacccataacttatctgattgatttgtacattgatttaacacaataagccagcgtgaagctacacggtggtataaacatgccttttcgagggattctgccttttcatcttttaccatagtaaagctcctttcgacgaactgaatttagcaaggagaatgttgtgatatatgcaaaaaaagcccacagggtgggcatgaaatcgaacatctggatttacgtattatctttgtaatacttgttttttaacataacgagacaaatacatcactgacaagtagataaaacttgtcgatttattcgttttttatgaataatgacatgcaatactattgattgttgtaaggtgattgaccgatatcattcggtgatttttttataattaattgtgtttttatataacgagctatttgtatgtgaatgttgtcaaatatagggttatccgcactggattttgtggtttttgagttcatacttaattaaggttgctgtcattaccacttaaacaacaaaaagaggatattttatgaaagagattacatttacagaaatggcagatgttagcggtgcaggttcagaaatctatctcactcctttacctggaactgatgcacctactaccggtgatgcaccgtttgttccaggaaagcccggatataaagaaaatgatgttccagacaattctgtatactcaggagacatgaaattgtgtaactgctgctatgaattagcaggtctgtagtcagacagtttgtatcaggaggctaatcgtgtttgagtttggtattcaaccggactcagacacttttaaagtagggaagatgtcaatcgtacaatgttaacattgaaatgaggcagaagtttggggcaccagtggggcaaaaatgacatttttggggtattttggggcagaaaagaacgtatgaaaatcgcttaagatcatacgattttaaaatcgggattttttaagttactgaaaatcatatgctcttggacgattttcgtatgattttaaaaaaaacacaaccacgtcctttcaatgatagcgtatcagcttgataatgcgtttgagatcgtgtgcttagctaacccgggagattcactatgcagttttcaacaaccccaacgctggaaggacaaagcatcgtggagtattgcggtgtggtaacgggcgaagccattttaggcgccaatattttccgcgattttttcgccggcattcgggatatcgtcggcggacgttccggcgcgtatgagaaagagctgcgtaaagcgcgtgaaatcgcttttcaggaacttggcgagcaggctaaagcgttgggtgccgatgcggtggtaggcatcgatattgattacgaaactgtcggcaaggatggcagtatgctaatggtcagcgtcagcggaacggcggtgaaaacgcgccgatgaaagcgctactgtggctggtgggtctcgcgttgctgttaacaggctgcgcgagcgaaaaaggaattatcgataaagagggatatcagcttgatacccgacatcgggcgcaggcggcctatccgcgcattaaagtcctggtgattcactatacggcggaaaactttgacgtttcgctggcgacgttaacgggtcgcaacgtcagttcgcattacctgattcccgcaaccccgccattatatggcggtaaaccgcgcatctggcaactggtgccggaacaggatcaggcctggcatgcgggcgtcagtttctggcgaggcgccacgcgtctcaatgatacgtctattggcattgagctggaaaatcgtggttggcgaatgtccggcggggtgaaatctttcgcgccgtttgaatccgcgcaaattcaggcattgattccgttagcgaaggatattatcgcgcgctataacatcaaaccgcagaatgtggtggcccatgcggatatcgcgccgcagcgtaaagacgatcccggcccgcgcttcccgtggcgcgagctggcggcgcaggggattagcgcctggcctgacgcccagcgtgtggcgttttatctggctggacgcgcgccgtatacgccagtcgataccgcaacggtgcttgcgttactctcgcgctatggctatgaagtcaaagccgatatgacggcacgcgagcagcagcgggtgattatggcgttccagatgcacttccgtccggcgcaatggaacggtatcgcagatgccgaaacgcaggcgattgccgaagcattactggagaagtacggccaggattaacgcggtaaatttccgtgatcgcgcagccaggcggcggtgcgctcaatgccttcgtccagcgtgacgatgggctggtagcccagctcgtcctgcgcgcgagtcgtatcgagcgtaaaatcaaaattcagttttgacacgccgtaatgcgttagcgggggctctttggcggattttttgccgaagcgctccatactgcgggcgatcatatccagcatcgggtaaggcacagagcgaatgcggcagtcgatagtcagttcatcaattaacttttgtacgatgctgcgtaaggtacggttttcgccgttagtgatgttataagcgcggccagaaggcagatgatcgcagcccggctggctggccagccacatggcgtggatcgcattttcatagtaggtcatatcgaccagcgcgctgcccccgtgcggtaataagacgctaccgtaatggtgcatcatatgcgccagacgtgggataaatactttatcgtgcgggccaaacaggctttgcggacgtaacaccgtaaaacgtgtttgcggattggcctgcgccaacagattaatcacctcttcgccggcggctttactgcgggcgaactcattggcaaaccgatgcgggcggaaatcttctttgatatcacggtgatggtggtaatcaaaatagagcgagggagaggagatatgaataaaattgcgcacgccccaggcgaccgcccattctcccagacggcgggtggcgcgaacattcgctagatcgaaagcctgttgggttccccagggcgaggtaaagctggagcagtgccacaacgtgtcgatcccggcaagcatcactttagcctgcgaggagaccagttcggttaaatccgcatggacgaattccgcgcccattttttcaagcagcttgcccatcgcttcattgcgacccgtcgctctgacgctgatgcctttattgcgcaaaaattcaaccgcgtttcgacctaagccgctggtggcgccggtaaccagtaccttcatatcaatccactgtgtttaataaaccgtcgtgcgcattcttccgtgaattacgtcggtatgcaatgggaaacacgaaagaatacagcaactttttctcatttttctgtgatttgttctgcaagtcgggcaatacgccttgccattccccggaaaataaacaggtgcgccgggatcatcagtagccagtaaatcaggcccggcattccgtgtggatgccaccaggcgcgcacgtcaatttcgcggtagcggcctttatcgtgcagcgtgaagctaagccgccccagacccggcgctttcatgccaaacaagagcgtgagctgtttttctggttcgacaatgatcactttccagctatctaccgtatcgccaggcttgagcaaggtatgcgacgggcggcctttcgccagtttatgccccaccagacggtccatcgcggcgcgcgtctgccacaaaatattgccgaaaaaatagccctctttgccacccagccgatttacgacctgccatagcgccgataggctggccggggtctgcgcggtaaagcccgcctgctttggaaaatagccgtattcgggacgccagcgggcgaaggccagcgcgtcgtagccccagtcgctggagttcaccagtttttcttcttctttcagcgtgcggcgaacggcgtcatcaaaggtgataagcgtttgggggatcaacttttttaacgcggcgtcatcggccagcaaatcgtgccttaatccctggattaacgcttttgcggtagttggcggcacggaggtaatgacgtttaaaaaccagaccgaaatccagcgggtcggaaaaggcaccgggatcagcggacgccgtttaccgctgacggccataaaacgttcaaactgctgctgataacttaatacctgcggcccggcggcttccagaatacgatgctcgcgagcagggtggtccagtaagccgaccaggtagtagagtaaattttccagagcgatgggcgtggtgcgcgaacgcacccagcgcggcggcgtgagtattggcaggttgtaaaccatgtcgcgcatgacttcgaaggcggcggagcctgcgccgacgatgatcccggcgcgtaattccgtcaccggtacgcctgcgtcgcgcagcgtgtcagccgtaagctggcgggcgcgcaggtgatcggattgctcatgcgccggtgcctgcagtgaactgaggaaaataagttgtttaaccggcgtctggcgcagcgcgtcgcgcacgttgagcgccgcctgacgctcatgggcgataaaatcgccgccttcgcccatgccgtgtaccagatagtaaacggtatcaatgtcgcgaagcagcgcgggtaaattttccggccagtgcagatcgaccttatgacaactgacgttggcgaggcgctgtttttccagacgttcgatgcgtcgcgccgccgctcgcacctgatgcccttgctgacttagcgcaaagaccaggtgctggccgatatagccgctggcgccgagaaccagaatgcgttgcgccacgttgctctccttagcgggctaaaaaggcgcgccagtgggcgacgacgtcggtaagctgttcgcgagagacatccagatgcgtcaccagacgcacaatcggcgcggcgttaatcaggatattccgttcccgcaaatagtcgccaagcgcggcggcctgtgcttcgccaacgcgaacaaacagcatattcgtttcgtggcgtatgacctccgcgcccgcttcccgaagctgctgcgccagccaggcggcgttatcatgatcctcttgcagacgcgccacgttatgcttcagcgcatacagtccggccgctgccagaatcccggcctgacgcattccgccgccgaccattttacgccagcgcgtcgcgcgtttaatgtaatcgcggttgccgaccagcagtgaaccgaccggcgttccgagaccttttgacaggcagatggtaaaagagtcgcaatactgcgtaatctcttttaactcacagccgtaggcaaccaccgcgttaaaaattcgggcgccgtcaacgtgcagcgccagtccacgttcgcgggtaaatgtccaggcgtctttcagatacgcgcgcggcagcactttcccgttatgcgtattttccagactgagcaagcgcgtgcgcgcgaagtggatgtcatccgctttaatcttcgccgccacgttctccagcggcagcgtaccgtccgcggcggcgtcgatgggctgcggctgaatgctgccgagcaccgccgcgccgccagcttcatagagataattatgcgcgccctgaccgacgatatactcttcgccgcgttcacaatggctaagcagcgcgaccagattggcctgggtgccggtgggtaaaaaaagcgccgcttctttaccggaaaggtcggcggcgtagcgctgaagggcgttaacagtagggtcatcgccgtatacgtcgtccccgaccggggcggtcatcatcgcctcgagcatggcgcggcccggtcgggtaacggtatcactgcgtaaatcaatcatggcacatccctggattttaaaaggtgatgtgcactgttttaccttagccagttcgttttcgccagttcgatcacttcatcgccgcggccgctaataatggcgcgtagcatgtacaggctaaagcctttcgcttgttccagtttgatctgcggcgggatcgccagctcttcttttgccacgaccacgtcaaccagtaccgggccgtcaatggaaaacgcgcgctgtagcgcaccgtccacgtctgcggctttttccacgcgaataccggtaatgccgcaggcttcggcgatacgcgcgaaattggtgtcgtgcagttcggtaccgtcggtaaggtagccgccggctttcatttccatcgccacaaagcccagcacgctgttattaaagacgacgatttttatcggcagcttcatctgtaccaccgagagaaaatcgcccatcagcatactgaagccgccatcaccgcacatcgcgataacctgacgacccggcgcggtagcctgagcgccgagcgcctgcggcatagcgttggccattgacccgtggttaaacgagcccagcaggcggcgcttgccgttcatttttagatagcgggccgcccagacggtcggcgtgccgacatcgcaggtaaaaatagcgtcgtcagcggcgaaatgactaatttgttgcgccagatattgtgggtggatggctttatcgctgagtttggctaagtcatcaagtcccttacgggcgtcccgatagtgctccagagctttatcgaggaatttacgattgcttttttcttccaccagcggcagcagggcgcgaagcgtggctttaatatcgcccactagcgccatgtcgactttgctgtgcgcgccaatactgcccgggttgatgtcaatctgaatgattttggcatcgctcggataaaaggcgcgataggggaactgggtgccgagcaggatcagcgtatcggcgttcatcatggtgtggaagccagaagagaagccaatcaggccggtcattcccacatcataagggttatcgtactcaacgtgctctttgccgcgcagggcatgaacgattggcgcttttagttttgccgccaacgcgaccaactcctcatgcgcgcccgcgcagccgctaccgcacatcaatgcgatattgctggagtagcgcagcagttgcgccagttttttcagctcttcctccgccggcgtgacgacggggagcggggcatggtaccaatgggtgacggcgttttcaggcgcgggtttcagcgccacgtcacccggcagtacgaccacggagacgccgcgatttaacaccgctttgcgcatagcgatggcgagtacctgcgggatctgctccgggctggaaaccaactcgcaatagtggctgcattcacggaacaactcctgcgggtgggtctcctggaaataaccgctgccgatttcactggacggaatatgggcggcgatcgccagaacagggacgtggttacggtggcaatcaaacaggccattgatcaggtgcaggttgcccggtccacatgaaccggcgcacactgccagctcgccggtaagctgcgcttgtgcgccggcggcgaaagcggcgacctcttcgtggcgggttggcatccattcaatggttcccatacgattaagactatcgctcaggccgttcagggagtcgccagtgacgccccagatttgttttacgccagcctgttccagcgttttggcgataaaagcagcaacggtttgtttcatggttctccatctccttaaatgtgataacggttacaagtttagttgaagatgacgatgacgtttttctttggcggagagaggggcgaaaggatgaagcgagtggtaaatcgcccggtggcgctgacgcttaccgggcctacgatggaacgtttaccgattatgcgagaacaagatcgccctgcggatggcaggagcaggccagtacgtaaccttcggcaatctccgcctcgctcagcgtcatggtgctactcaccgtatagtcgccggaaacgactttggttttacagcagccgcaaacacctgcccgacaggcagcggcaaccggtactttattactctccagcgcctccaacagcgtcgtaccgatcggggcataaaattcctgcgctggctgtagcttggtgaatttcaggccgctggttgccgtttccgccaccggcgtgaagaacttctctttaaagaagcgcgttacgccaagcgctttcactccctgttcgacgaaatccatatagggcgccgggccgcaggtcatcacggtgcgcgatgccaaatccggtacgctctgtaacaattccgtggtcagacggcccgcgataaaaccttccgtggcatgattttccgccactagcgtgaccggatactgtcgccactcgtcggcaaaaatcacatcatccggcgaacggacgttaaagatgacctgcacgtcggcctgcgggcggtatttcgccagccagcgacgcatcgacatgattggcgttacgccacaaccggcggcgagcagcagaaacttatcttctgttttatcgtcacaggtaaaatcgcccattgcatcagacagccagatgtaatcgccgcgcttgatgtcatgggtcaaccactgcgaacccgtgccatcgtcaatccgacgaacggtcagcgtaatatattcactgacgcccggcgtagacgaaagggtgtaggcgcgcagcgtttccgctgaattgcgcacgctcaccagcgcatactgcccggcgcggtaagggtagtagtcatggcataatagcgcaattgtccatacatccggcgtctcctgacggatgtgatgcacctgcattcgccagggacactgtgaggttggcatcgtcatcattgacctccttacgcgctcagcaattgcttcatgtcttcttcaacggtggtcacggaacgcagaccgaacttctcgttgaggatagccagcagatccggcgtgaagaagcccggcgcggtcggcccggtgacaatatttttcacgcctaatgacagcagcgtcagcagaatcacgatcgctttctgctcaaaccaggagagcaccagcgatagcggcagatcgttgacgccgcagcccagtttttccgccagcgtcaccgccaggataattgcggagtaagcatcgttacactgaccggcatcgaccagacgcggcagcccttcgatgtcgccgaactccagtttgttgaaacggtatttaccgcacgccagggtcaggatcaggcagtcatccggcacgctggtggcgaaatcggtaaagtagttacgctcgccgcgcgcgccgtcacagccgccgactaggaagatgtgacgcagtttttcacggctgaccagatcgatgagcgtatcggcagcgccgagcagggtctgacggccaaaaccgacggtgatgatatgcggaatttcgctatacgggaagcccgccatttgctgcgcctgggcaatgaccggcccgaagtcatcgccttcaagatggctaacgcccggccagccgacgatgctacgggtccagatacggtcgtcatagctgcccacggtcgggtcgataatgcagttagaagtcatcacgattgggccagggaagcgggcgaattcgacctgctgattctgccagccgctgccgtagttaccgaccagatgcttgaatttacgcagttccggatagccgtgtgcgggcagcatttcaccgtgagtgtagacgttaacgccggtgccttcggtctgctccagcaggttgtagagatctttcagatcgtgaccggagatcagaatgcacttgccttcagtcgctttgacgttgacctgagtcggcgtagggtgaccgtatttggtggtttcaccggcgtccagaatgctcatcactttgaagttcatctggccgatttccattgcgcactccagcagcgcgttcatgtcagcaggccaggtgcccagccaggccatgattttgtggtactgcgcgtaaatgtcgttgtcgtattgaccgagaacgtgcgcgtgctccatatacgccgccgcgcctttcagaccgtacaggcacagcagacgcaggccgaggatgttctcgccaatggcggctttgtctttattcggggtaaattccgccgcctgacgttgcaggtcgcccagatcgtcgctgaccagttgcagatcggccatcggattgtcgcaatgcgcattggcatccacgctcaggcactgcgctttcaacgcttcacgcaaggcaatcgcttcacgggcgtagccgacgatacgcggagagtcgaagttaacgttggtcagcgtggagaaaaacgcgcgcggcgcaaagttatcaacgtcgtgattaatgatgccatattcacgggccttcaccgcccaggcagacaaaccttgcaaagccgcaatcagcagatcctgcagatcggacgtttcagctgttttaccgcacattccctgcgcgtaggagcagccgtttccggctggtgtacggatggtttgttcacattgcacacaaaacatggtcacaccttttaaagttatatttaatatacatgtttaaggttatgcctgtgaacaaagggataaaagggatttctgccataatgtgcagggagattgatttagcgcaattttggcggcagatgcctaccgccaaagaggtatcaggccgagaagaacgccattaagagggggaccagcaggctgaggataaagccatgtacgatagccgccggaacaatctctacgccgccggagcgctgtaataccggcaacgtaaagtccattgaagtcgctccgcacaggcccaacgccgttgaacggctgcggcgaaccagaccgggaataagcataatggctaagagctcgcgggccagatcgttaaaaaatgccgcgctgccgataaccggtccaaacgactccgtcagcaaaataccggaaagagagtaccagccgaaacctgacgccatcgccagggcggtttttagcggtaagtccaggataaacgcattaatcacgccgcccagtaatgagcttgccacgacaacgaccgcgaccatcattccccggcggttaagcacaatttgctttaaggtcatgccgctatttcgtagctgaatccccaccaggaacaataaaaagatcagcgtatattcactggcttcggtggcgtgctgtaaaacagagagtccgctcaggccgatgacaaaccccaataccactacgccgcacagttgcagcgactccagcgccatggcaatacgtgaaggcagtttttcctgctgatgatggtgacgccacgggaggatacgttccagccacaataaggcggcgatattacacaataaaataatcgtaatactgacggcggaataatgaaaaatcgccaccagattactggcgaggttatccaaaaacgccaggcttattcccataaaaaagagaataaggtacacgatccagctcagtagccggttaataagttgtaatgcggctttatgtcgcagtggaatgagatagcccacaatcagtggaaccagaatgattaaaagtcctgaaaacatgaacagccgggcccttttttattgtttgaatagcgtacatgacactaccgaattccagactatcagtaaagcgacaccgtcagccgtacatttatcagacatttgccccaggcaaagggggggaatatcacgccaggcggacgcatttgccgttatactgcggtgaattttatggagtgatgacgtttttctggaggaagcatgattctcgaacgcgttgaaatagtaggatttcgcggtatcaaccgactgtcgttgatgctggagcaaaacaacgtgctgattggggaaaacgcctggggcaaatccagcctgctggatgcgctgactctgttattgtcgccagaactcgatctctaccattttgtccgtgaggatttctggtttccgcctggcgacataaaaggacgcgagcatcacctgcatattattctgacttttcgcgaaacgcagccagggcggcatcgggtacgtcgttatagagcgctggaagcatgctggtcgctttgcgaggatgattttcaccgtattttttatcggctagagggcgaatgcggcgccgatggcagcgtgatgacgctgcgcagttttctcaatagcgatgggcagccattactggtggaaaatattaacgatcaggtgcgccacctggttcgtctgatgccagtgctacgtttgcgcgatgcgcgctttatgcgacgtattcgcaacggtacggtgcccaatgtgccggatgttgaagtcacggcccgacagctggattttctggcgcgtgagctggcgacccggccgcaaaatttaaccgacgggcagattcgtcagggactgtccgcgatggtgcaactgcttgaacactatttctcagagcagggcgcaggacaggcgcgtcaccgactcatgcgccggcgttcgcaaaatgagcagcgtagctggcgctatctggatattattaatcggatgatcgacaaaccgggcagccggtcgcatcgggtgatcctgctggggcttttctccacgctgttacaggcgaaagggacgctgcggttacataaagacgcacgaccattactgctggtggaagatccggaaacccgtttacatcccattatgctttcagtcgcctggcaattgctcaatctgttaccgctacagcggatagcgacaaccaactcaggcgaactgctttcgctaacgccggtggaacatgtcgtacggctggtgcgcgaatcttcccgcgtcgccgcctggcgtctgggcccgggcgggttaagcgcggaagatggacggcgcatcgcctttcatatccgctttaatcgcgcgtcgtcgctgtttgcgcgttgctggctactggtggaaggcgagacggaaacctgggttattaatgagctggcgcgtcagtgtggacatcattttgatgcggagggcattaaagtcattgagtttgctcagtctggcctgaaaccgctggtgaagttcgcccgccgtatgggaatcgagtggcatgtcctggtggatggcgacgaagcggggaaaaaatatgccgcgacggtccgcagtctgcttaataacgatcgggaagaagaacgcgaacatctcacggcgttgcctgcgctggatatggaacattttatgtatcgtcagggctttgccgatgtttttcaccgggttgcgcaacttccgcctaatgtgccgatgaatacccggaaaattatcactaaagctatccaccgctcgtcaaagccggatttggcgattgaagtcgcgatggaagccgggcggcgcggaattgacgccgtgccgccgctgttcagaaagatgttctcgcgcgtggtttggctggcgcggggccgggcggattagcgtttgaatgtggccggaacctgttcgacgacgctatcgagtaatgcatagcggcggcgatactcggcccgttttttactggcgatctccgcttcgctttttcgggcgatcgccagcggcagcgtatagtaattccctttaattctttcaccgcctaacgattcccaaaacgcgtcatagtcggcatgcatttgcgtctttttatccatgtatcgccagctacgataaacgtgcgcatcgttactcacggctataatcttttctgcctgaaagacttgcgcaaactgacagagagcctccatcacgatgcgtttgggaaaaagaccatggcaggctttggtcgcctgctggataatttcgtgagggacgtcgtttgccgcgccctgtaatccgccgataaatagtgtgcgttgttggttaaagcgacacagggtaaatgtgatctctgccagaatacgtaactgtgcgtcgcgaacaacaatagtgctttcaccttctttatccagtgagaccagactgactaaatcaagttgaaacaactcgccggttttagtttcaaatttagcaagattcaggccatactgacttaaatagctaacttgttgttcccgcgataaaagttggcgcatctgttgataatgaaaacacagcgcatctaaggcgaaatcgcgtttaatatttacagccatataaggacgatgtagccgaataggcaaacgcggctgacgagcaagtaacgtatttaactccggccattgggtgagattggtcagtaattggctggtcgcacgcggcatgactaatgagcggattaaaaacttgcgacgaaagctggctttacgccagaattttcctggctgtaattgcccgcgcgtcagacgaataaataattgtaaaggagagatgtaatctgaagtgtaccaggtattatctgtaagctgtgtcatgatcgtaatccgcgacataagattgtcgagattgaaccacaggaaacattaaccaatcgtcaatacagccggcgctatctttattgcgtcaggtttgtttagatacggtttactttctggttaaaattttgccgtcagggtttctatgcgtgctaagggaaagaaatttaaaaagcgttatctggtcattattttaattcttttagtgggggggatggctggctggcgaatgataaatgccccgctgccaacttatcagacattaatcgtgcggccaggcgatcttgaacagagtgtactggcgactggaaaactggacgcgttgcgtaaagtggatgtcggcgcgcaggtgagcggccagttgaaaacgctgctggtctccattggcgataacgttaaaaaagatcagctactcggcgtgattgacccagatcaggcggagaaccagataaaagaggtcgaggccaccctgatggagctgaacgcggagcgtcagcaggcagccgctgagttaaagctggcgcgggttacgctggcgcgccagcagcagttagctaagactcaggcggtatcgcaacaggatctggataccgcggcgacggagatggcggttaaacaggcgcgtattggcaccatagatgcccagatcaaacgtaatcgggcctcgttggacaccgcgaaaaccaacctggaatatacccgtattgtcgcccccatggcgggggaagtgacgcaaatcactaccctgcaaggacaaacggtgattgcagctcagcaggcgcccaatattctgacgctggcggatatgagcaccatgctggtaaaagcgcaggtctcggaagcggacgtgatccatcttcgggcggggcagaaagcatggttcaccattgcaggcgatccgcaaacgcgctatgaaggcgttttaaaagatattctgccgacgccggaaaagatcaacgacgctattttttattacgcccggtttgaagtgccgaatcccaaaagaatcttgcgtcttgatatgaccgcacaggtttatattcaactcatggatgtcaaaaatgtgctgattattcctctcgccgcgcttggcgaaccggtgggcggcaatcgttataaagtggcgctgttgcgtaacggcgaaaaacgtgagcgcgaagtggtcattggcgagcgtaacgatacagacgtggaagtggttaaaggtctggaagcgggcgatgaggtgatcatcggcgaaagcaggccaggagcgacgccatgacggcattgcttgaactgtgcaatgtgagtcgtagctacccctccggagaagagcaggtggcggtgttgaaagatatctccctgcaaatccacgccggggagatggtggcgatcgtcggcgtttccggttctggaaaatcaacgctgatgaatatcctcgggtgcctggataaaccgaccagcggcacttatcgggtggcggggcgggacgtctcgacgctggacccggacgcgctggcgcagctgcggcgtgagcattttggctttatctttcagcgctaccatctgttgtcgcatttaacggcagcgcaaaatgttgaaatccccgccgtctacgccggcattgaacgcaaaaaacgccaggcgcgcgccagagagttgcttttgcggctgggattaagcgatcgcgtcgattacccgccttcacagctttctggcggacagcagcagcgtgtcagtattgcccgcgctctgatgaacggcggacaggtgattctggcagatgagccgaccggcgcgctggatagccattccggcgaagaggtgatggcgattttgcgccaactgcgcgatcgcggacatacggtgatcattgtgacgcacgatccgctgattgccgcccaggcggagcggattattgaaattcacgatggcaagattgtccataatccgcccgcgcaggaaaagaaacgcgaacagggcgttgacgctgccgtagttaatacggctcccggctggcggcaatttgccagcagctttcgcgaagcgctgtcaatggcgtggttagcgatggccgctaacaaaatgcgtactttactgaccatgctgggaattattatcggtattgcgtcggtggtgtcgattgtggtggtcggcgacgccgcaaaacagatggtactggcggatatccgcgctatgggcactaacacgattgatattcatccaggcaaagattttggcgacgacaacccgcagtatcgacaggcgctgaaatatgacgatctggtggctattcagaaacagccgtgggttaactctgcgacgcccagcgtttcaaagagcttacgtcttcgctatggcaatattgatattgccgtaaatgctaatggcgtcagtggcgattattttaacgtttacggcatgtcctttagggaggggaacaccttcaatgctgtacagcaacaggatcgcgcgcaggtggtggtgctggatgccaacacgcgacgccagctatttccaaataaagcgaatgtcgtaggggaagtggtgctggcgggtaatatgccggttattgttattggcgtggcggaagagaaaccgtccatgtacggcaatagcaatctgttgcaagtttggttgccctatagcacgatgtcagatcgcataatgggtcagtcatggcttaactcgatcaccgttcgtgtgaaagatggcgttgatagcgatcaggctgaacagcagcttactcgcctgctcaccttacgccacggtaaaaaagacttcttcacctggaatatggacagcgtcctgaaaacggctgaaaaaaccacctatactcttcagttatttctgacgctggtggctgtcatttcgctggttgtcggcggcatcggcgttatgaatattatgctggtttccgtcaccgagcgaacgcgtgaaatcggcatccgtatggcggtaggcgcgcgcgccagcgatgtgctacagcagtttcttattgaagcggtgctggtttgcctggttggtggagcgctggggattagcttgtcgatgttcatcgcatttatgctacagcttttcctgcccggctgggagatcggtttttcactgactgcgctggcgagcgcgtttttatgttcgacgtttaccgggatactgtttggctggctaccggcgagaaacgcggcgcgactggacccggtggatgcgctggcaagggagtaatcttgctgacgtcatttgtcggcctgataagatgcaacagtgtcgccaccaggcactggcgttaaataaaaatgccagccgatcgggctggcattttgcctcctggatgtacacaatgagacagaggagctatgcaacggcctctgcttcgatgggcacgatgacgctggcgtgattgccttttggcccctggtggacatcaaaccggacagactgtccggctttaagcgttctgtaaccatccatttgaatggtggaataatgggcgaaaatatcctcgccgccgccttcagggcagatgaaaccaaaccctttggcattgttgaaccactttacagtacccgtttccatgcttcgacatccttcgtaaatcttatataagtaagatggaatgaaccggtgacggagtgggggctgttcaaaacctcaccaactctcgacattacaatttagagaaatcaggcgaggcgtcaagcatcaggcaggggggatcgggtaaaaatgaatcaaaaatttgaagcagttaacgctattgccgggaatgtgacagatgtcgcggatggtactgatagatgttagttatctatcaattgaggtagattgattgtgtgcatagactctggtcagcggcagattttcctgccgacaactgtaaccgataatgacgactgacaatgggtaagacgaacgattggctggattttgaccagttggtggaagatagcgtgcgcgacgcgctaaaaccgccatctatgtataaagtgatattagtcaatgatgactacactccgatggagtttgttattgacgtgttacaaaaattcttttcttatgatgtagaacgtgcaacgcaattgatgcttgcagttcactatcaaggcaaagccatctgcggcgtgtttaccgccgaggtggcggaaaccaaagtggcgatggtgaacaagtatgcaagggagaacgagcatccgttgctgtgtacgctggaaaaagcctgaatgcaggtataaaaattgggggaggtgcctatgctcaatcaagaactggaactcagtttaaacatggctttcgccagagcgcgcgagcaccgtcatgagtttatgaccgtcgagcatctgttgctggcgctgctcagcaacccatcggctcgcgaagcgctggaagcatgctccgtggatctggtggcgctccgtcaggaactcgaagccttcattgaacaaaccacacccgtactgcctgccagtgaagaagagcgtgatacgcagccgacgttaagtttccagcgtgtcctgcaacgtgccgtcttccacgttcagtcttccgggcgtagtgaagtgactggcgcgaatgtgctggtggctatctttagcgaacaggaatcacaggcggcttatctgctgcgcaagcatgaagtgagccgtctggatatcgtgaactttatttctcacgggacgcgaaaagacgaaccgagccaatcttccgatctcggcaatcagccaactggcgacgaacaagctggcggggaggaacgtatggaaaacttcacgacgaatcttaaccaacttgctcgcgtgggcggcatcgatccgctgattggtcgtgaaaaagaactggaacgcgcgatccaggtcttgtgtcgtcgccgtaaaaataacccgttgctggtaggggaatccggcgtcggcaaaacggcgattgccgaagggctggcctggcgtatcgtgcagggcgatgtgccggaagtgatggccgattgcaccatttactcgctggatatcggttcgctgctggcgggcaccaaataccgcggcgattttgaaaaacggtttaaggcgttgctgaaacagcttgagcaggataccaacagcatcctgtttatcgatgaaatccataccattatcggcgctggcgcggcgtcgggcggacaggtggatgcggcaaatctgattaaaccgctgctttccagcggtaagatccgggtgatcggctcaacgacctatcaggaattcagcaatatttttgagaaagaccgggcattagcgcgccgtttccagaaaattgatattaccgagccttcggtggaagagacggtgcaaattatcaacggcttgaaacctaagtacgaagcgcaccacgacgtgcgttataccgcgaaagcggtgcgtgcggcggtcgagctggcggtaaaatatatcaatgaccgccatctgccggataaagccattgacgtgattgacgaagcgggcgctcgggcgcgtctgatgccggtgagcaaacgtaagaaaacggtcaacgtggcggatattgagtccgtagtggcgcgaattgcgcgaattcctgaaaagagcgtctcgcagagcgatcgcgatacgctgaagaacctgggcgatcgtctgaaaatgctggtcttcggccaggataacgcgattgaggcgctgaccgaagctattaagatgagtcgtgcgggtctgggccatgagcataaacctgtcggctcattcttgttcgccgggccaactggcgtagggaaaactgaagttacggtacagctttcaaaagcgctgggtattgagctgttgcgcttcgatatgtctgaatatatggagcgtcatacggtgagccgtttgatcggcgcacctccgggatacgtcggtttcgaccagggcgggctgctgacggatgcggtgattaagcatcctcatgcggtgctgttgctggatgagatcgaaaaagcgcacccggatgtctttaacctgctgctgcaggtgatggataacggtacgctgaccgataacaacggccgcaaggcggatttccgcaacgtggtgctggtgatgaccaccaacgctggcgtgcgagaaaccgaacgtaaatctattggtcttattcatcaggacaacagtaccgatgcgatgggcgagatcaagaaagtgtttacgccggagttccgtaaccgtctcgacaacattatttggttcgatcatctgtctggcgaggtgattcatcaggttgtcgataagtttatcgtcgagttgcaggctcagttggatcagaaaggcgtctctctggaagtcagtcaggaagcgcgcgactggctggcggaaaagggctatgaccgggcgatgggcgcacgaccaatggcgcgtgtgattcaggataacctgaaaaaaccgctggccaatgagttgttgtttggatcgctggttgacggcggacaggtcaccgtcgcgctggataaagagaaaaatgcgttgacgtatgacttccagagtgcgcaaaagcacaagccggaagccgcgcactaatcttcgtttcactgtcgtacaaaccgggccttagcgcccggtttttttgtctatggaaaacccccagctaggctgggggttccggaaagctttcagctttaagccagttattaaaaccccttttgatttgttaaaacatcttgcggtctggcaactgcaaaagttcaacaagaaatcaaaagggggtcccaatgggggacgaaaagagcttagcgcacacccgatggaactgtaaatatcacatagttttcgcgcccaaataccgaagacaagcgttctatggagagaagcgtagggcagtaggcagcatattaagaaaattgtgtgaatggaaaaacgtacgaattctggaagcagaatgttgtgcagatcatattcacatgcttctggagatcccgccgaagatgagtgtgtcgagtttcatgggatatctgaagggtaaaagtagtctgatgctttacgagcagtttggggatctaaaattcaaatacaggaacagggagttctggtgcagagggtactatgtcgatacggtgggtaagaacacggcgaagatacaggactacataaagcaccagcttgaagaggataaaatgggtgagcaattatcgatcccgtatccgggcagcccgtttacgggccgtaagtaacgaagtttgatgcaaatgtcagatcgtatgcgcctgttagggcgcggctggtaagagagccttataggcgcatctgaaaaacctccggctatgccggaggatatttatttacgccggataatagttagcctgatagcgttgtgctcgcggtaggcggataaggcgcttgtaaattgcgtcatcatccggtaatcgacgggtcaaatgcgaaaaaaagtccgtactttcgtacgaactctttcttgaatatggcggtgaggggggattgactcgctgcgctcgcccttcgggcagtctcctcgcaggctcgtcgtttgtccaactggctgcgccgctactcagcccatccctgggcctcgccccttcggggccagagcaagctctgttcaaaaacgctcccggcgtttttgtgtcgaaccccggtcgggtgttctcatcccccctgtagggtggctttattgactagtcctgatataggttgacagttttttgtctgtaaaacgcctgatgaacatcatcgggcgttttgtatttcagggccaggtgtggccgttcatggttataaattgccacggactcttttactatttcccgcgcttgctccaggtctgcaggacgcgagagtaaaaactcatttttcagtatcccgtttattctctcagccagcgcattctggtagcagtcgtaaccatcggtcattgaacaggttattccgtttcgctcatgaactgactgataaagtaccgaacagtattgcagtcctctgtcagagtgatgtaccagcggacctgtcgtttttctccgcctcagagcctgcctgaacgcctttaccacattttctgtctgcaggttttccccgacatggtaacccacgatttttctggagcaggcatcggtgaccagactcagacaggccgtgccgctgcgtagtggaaggtaagtaatatcggcgacccagacctgctctggctcaagggcggtaacctgttcagggccgggtttcagcagattaggatgccggtaaaagcgatgatggctgttggtggttttgtgatatgcccgtttcacgggtaccaggagccggtattcacccagcagattaaacagacggtcccgtccgatattcagcgttttatcggcctgcatgttcagcagatagtgcagtttacgcgtaccgattcgcggctggcggcaccgggtacgggcaacaaaatcaagaacctgagcatgatgctcctgccgtttattacatcttgtattgtactggtaccacgcctgtctgctgtgccccaggaactgacatgcacgcgtaactgttattttgggggcctgactttgcgtgaggacttgccgggccgcttttttacaacacttaccccgtaatcatttttcaggacgttgataacggactcaaaaaactcagctttctggtttgccagctcaagctgttcttcaagttccctgattctttgctcgggtgtcagcgggatagttgtctgagccacaggcagtttcctcttcaccaggtcaggaagtccgggtctccagtcaagccggccatatttacgcagccagacaagtacggtggagcgcccctgaatgccatatcgctgctgggcctgtttataggtcatctcgcctttttcgacctgctcaacgacggctattttaaaggatagaggataatcgcgttgggtgcgtttgaactcagtcatcatcacgttctccggatttaagtctggaacgtgtcaacgctattcaggacgggtcatatgtgaaaaaaaagcccgtactttcgtacgagctctttcttgaatatggcggtgagggggggattcgaacccccgatacgttgccgtatacacactttccaggcgtgctccttcagccactcggacacctcaccatattgtattgctgcctgaccacttggggggcaacggggcgctactatagggagttgcgctaaaacggtcaagcagaatttacatattcactgtcgtttgctcatgcaatagacataatccccgcccaaactggcgcggggaggcaaattaacgctgtgaatccaacatttcgttgtttttcaccacatcctgcgctttgctgtagctttctatcagcagttgataggccgggaatacctgagtataaacgtcggcccacgcggcggcgtcttcacggttccaggtgccttgcagctcagaggcgactgcggcagtatccatcggtacgacgccagcctgtacgatacgcgccagggtgatctcctgcgccatcttactgtaggtaccggatgcgtcgatcacggcaaataccttataaccttccgctaccgcgctaatggccgggaatgccatgcacacgctggtaatcgtcccggcaatgatcagcgtcttacgacccgtcgcttttaccgccttaacgaaatcttcgttatcccaggcgttaatttcacctttgcgcgcaatgtactgcgcatgtggcgcattagcgtggatctccgggatcagagggccgttcggaccttgcggtacggatgccgtggtaatgaccggcattttcgctaacgtcgccatcttcgccaacgccgcggcgcgagcgcgtaattccggcattggcatatcgcctacggtctggaaaagaccgctttgatgatcgattaaaagcatcacggaatcgttaacatcaattaccgggcgcaaaccattaaaattagcaggacttgacatcgtattctccttcatgttttcagatttggccaaaacggccggagttgaaatcgcgaactgcttctgcgatctcttgtttcgtgttcataacaaatgggccgtaacccacaatcggttcattcagtggctcgcctgataacagcaatacgctggcgtcgctgctggcctcaaggtgcagcgttttcccttgctggctcaacaccaccagttgcgcttcgttgaccggcgtcgtgccgttcaccgtgatattgcctttcagtaccaccagcgcggtgctccatccttccggctgtgccaatgtaagctggcgattgcgttgcaggcgcatatcccagacattgagcggcgagaaagtgtgcgccgggccttttgtctcttcataacgccctgcgatgacccgcacgactccggcgttatccggcaacgtaacggtcgggataacatcgtgggtaatgctttgataacccggggtggtcattttgtccttcatgggaaggttaacccacaactgcaccatttccagttcgccgccccgacgggtaaacgcgtcggaatggaactcttcatgcaaaatgcctgcgcctgcggtcatccactgaacgtcgcccgggccgataacgccgccgcgaccggtagagtcccgatgctcgacttcgccactataaacaatcgtcacggtctcgaaaccgcggtgtggatgctccccaacgccgcgtttttcattacccggcgtaaaggtgtgcggcccggcataatccagcagcaggaagggactcaactgctgcgcatgtgactgataagaaaagagtgaacgaaccggaaatccatcgccaacccagtgcgggcgaggtgcggtatagacgcctgtaatctgtttcatggtgttctcctcagtggcgttgtcttgatgtgaataagcttatattcatgacaaaaggttcggtagtggctaaaatggctcataccgttccattaataggacaatgtaatgataaaaacggatctcaatgattttgcgtggtttgtgcatgtggtcgaagagggtgggtttgccgcggcggggcgtgcgcttgatgaaccaaaatcaaaactgagccggcgtattgcgcaactggaggaacggctgggcgtgcgattgattcagcgaaccacccggcagtttaacgttaccgaagtggggcaaacattctatgagcactgtaaagcgatgctggtggaagctcaggcggcgcaggatgccattgccgcattgcaggtagagcctcgcggtatcgtgaagctgacctgcccggtgacgctgctgcatgtacacatcggcccaatgctggcgaaatttatggcgcgttatcctgatgtttcgctacagcttgaagcaaccaatcgtcgggtggacgtcgtaggggagggggtggatgtggcgattcgcgtcaggccgcgcccgtttgaggatagcgacctggtgatgcgcgtcctggctgacagagggcatcgcttgtttgccagcccggatcttatcgcacggatgggaatcccttccgcgccggcggagttgagccattggcctgggctaagtcttgcatccggcaagcatatccaccgctgggaactttacggcccgcagggcgcgcgtgcggaagtccattttaccccgcgtatgattaccaccgacatgttggcgctacgcgaggcggcgatggcgggcgtggggcttgtgcagctacctgtcttaatggtgaaagaacaactggccgccggtgaactggtcgcggtgctggaagagtgggagccccggcgggaggttattcatgctgtgttcccatcccggcgaggattattaccttccgtacgtgcgttggtcgattttttgacggaagagtatgcgcgaatggtggaagagtaacctgctcgtcattcatcaacttaatggacgcaaaaaaggccggttaaaccgaccttttatccagccgcccttcagggcgtgaggagacaattagcgactacggaagacaatgcggcctttgctcaggtcgtacggggtcagctcaacggtcactttgtcgcccgtcaggatgcggatgtagttcttacgcattttaccggagatgtgtgcagtaaccacgtgaccgttttctaactctacgcggaacatggtattaggtaacgtttcgagaacggtaccttgcatttcaatattgtcttctttggccatctaatcctctggggtatcactaccataatttgaaccggcaagataatgccgaacttcttttgataagtaaagatttgtgcgtttaaaacacagcaaaccaggtttagcacatgattccgcgacacacgacaacgccgcgttatacaccttttccctgatactaccgcctgatgtatcgacataagcgcaacatataagggaacggtgaaataaacgatgggcgttacctgacaacgggctgcgggataatgagctaaaccaattctgcggcagcaattataacaccccaataaaaaatgtgccgaaaacattcacttccggggcaaaaataatgtccgcggcacccaaaaacgggaggccagcggctgttggcgtaaggccgcgaggtgatcgaggtagtcacgacgtggaatttcaatggcgccgagcgaggcggtatgactattaagtacctgacaatcaataagtttaccgccgtgacgggtaaattcagcgcaaaaaaccagcagtgcggttttagaggcattctcctggcggctaaacatcgattcgccgcaaaacagcgccccctgcgagacgccatacatcccgccgaccagttcccgatcgcgccacacttcaatggagtgcgcgtggcccaattcatgtaatcggcgataggcttcctcaataccacgcgttatccaggtgccttcgtcacggtgattggcgcatccatcaatgacccgatcgaaagcgtaattgagcgtcacgcggtaaggggatgcgttgtgaaagcgcttcatactgcgactgaggtgaaacttttcaggccacagcacggcgcgaggatcgggcgaccaccacagaatcgggtcgcccggcgaaaaccacggaaaaatcccgtgctggtaggccattaacaaccgggcagggctgagatcgccgcccagcgccagtaaaccgttaggctcgcgtaaagcgccttccggcgaagggaaggcgatagaatgtcgggaaagctgaaccagacgcatgacggcgaaactccagtacgcaagtcggatcgttcaataatagcttacagacgttgtttaaactgataatagcgcccttgtccggctaacaattctgcatgagtgcctcgctcaatgatgtgcccgtcgtccattacgatgatttgatcaaaacgggccaggccgcgcaaacggtgagtcaccatcaggacggttttctcgcgcatcacatcggcaagtaattccagcatttcgctctcggtggtcgcatccagcccctcagtaggctcatccaacagcatcaacggggcatcgtgcaacagcgcgcgggcgatggccagacgacgaagttcgccgccggatagcagacgaccgccttcgccgagccagctattaagcccactatcttcgagcagattttcgaggccgacgcgacgcagcatgtcggaaagggcttcgtcgctggcattgggcgccgccagtaataaattatcacgcagcgtggcgctgaacaggtggacacgctgcggcaccacgctgatagtccggcgtaaggcggattcgctcagcgaggatagcggaagatcgttgagcagaatttcgccttgttgcgggtcccaggcgcgggtgagtagctgcaacagcgttgattttccgcagccggtacgccccagaatagcgacatgctcgccaggattagcctgtaatgagagggcattgagcgcattaatcggctggtcgggataacgaaacgaaacgtcccgcagggtgagtgtgaccttttccggcgcgggagtttctgcttgcggaaaggtcacctccggtttttgctccgttaattcagtgatacgaagcgcagaggcgataacctgccccagatgctggaatgcgccggtaacgggcgcaagcgcctcgaaagccgccagcgcgcagaagacaaacagcgcgatgagcgcgccgggctgcgtattgccgccaacgccgccggaggccatccacaacattaacatcaccgccagcgcaccaatcagcagcattaacgcctgcgataaggcggtgagttcagactgtcggcgttgggcctcatgccattgtaattcggtggcttccatttgcgcccgatagcgtttgctggcgccaaaaatggtgagttccgcctggccctgtaaccatgacgtgagctgctggcgatactgaccgcgtagatgcgtcagattttggccggtatttttgccggcgcgataaaacaccggcggcataataaacagcgtcaacagcataatgccgcccagcgtgatcgccagcgtcacgtcgagaacgctaagccccagggtgacaatcataatcactacaaaagcgccgaccagcggggagatgacgcgcaaatagagatggtccagcgtgtcgacgtcggcaacgatgcggttcagcagttcaccttgctgataacgcgccagactcgcgggggagagtggtagaagtttgctaaaggtataaatacgcagatgttgcagtacgcggaacgtggcgtcatgacttaccagacgttcaaaataacgaccagcggtacgggtaatggccgcgccgcgcacgccggctgccgggagcatatagttaaaactgtaaattcccgcgaagcctgcgatagcggacgcggacaggaaccagccggaaagcgtcagcagcccgatactggcaagcagtgtcaggattgccagcgcaattcccagcgttagcatccatttatggcgtttataaagcgtcagataagggagtagcgcgcgcatttaaatatcctcctgacggtgagccaataacgtcgcaaaagcgccgttggcggcgctgagttcagcataactgccttgttcgacaatcgcgccatcttgcataacccagatagcgtcccagtcggcgagatcttccaactgatgcgtcaccattaatgtggtctggcgttttgacgccgcttttaacgcctgcatgacgcgttgctcgctgtgagcgtccaggcttgccgccggttcatccagcagtagcagttgacagggattaagtagcgcacgggcgaccgctacacgctgtgcctggccgacggaaagtctgctggcatgattgccgagcggggtgtctactccctgcggcagcagcggtaaaaactcgcttacccatgcggcgtcaagcgcggcataaagttcctgctcgctggcgtccgggcgcgccagtaatacattttcgcgtagcgtcgctgcaggtaattgcgggttttgcccaacccaggagagatgctggcgccaggattccggcgagagatcgcgaagctcgacaccgttaatacgcaaagatccctgataggagagaaaaccggataatacattcaacagagagcttttaccggaaccgctgcgtcctaccaggacggcgcgttctcctgccgctaatgagaaattcagcggcccggcaagcgttttgccttctggcgaggtgataataagattgactgcgtcaatggttacaggttcgttttccgccagctcaacttcgccgcgcgccgggtgggcaaggggtgtttccagaaacgtcttcagactatccgccgcgccaaccgcctgcgccttagcatggtaaaacgtgccgaggtcgcgtaacggctggaaaaactccggcgcgaggatcaaggcgaggaacccggcggcgagcgtcacgccggtaccgtaatgaccaaagttcagttcgcccaggtaagagaagccaaaataaacggcgaccagcgcaatagaaagcgaggtgaaaaattccagcacgccggaagataaaaaggcgaggcgcagtacttccatcgtgcgctgacgaaaatcctgcgatgctgcgcgaatgctttcggtttccgcttctccacgaccgaaaattcgcagcgtttccatcccgcgcagacggtcaagaaaatggccgcttagccgggcaagcgccaggaaattgcggcggttggcgtcagccgcgcccatccccaccattgccataaataggggaatgagcggggcggtgcccagcagaatcagcgccgccgcccaatttgacgggaaaatcgccgccacgattaagagcggtacgcaaacggcaagcgccatttgcggcagatagcgcgcataatagtcatgcatatcgtcaatctgttccaataccagcgtcgcccagctaccggcgggcttgccctgaatccaggctgggccggcttgctgcagacgatccaacacctgacggcggatctcaaagcgaatatgttgtccggcatgaaaaccgacgcgctcgcgcaaccacaccacccaggcgcggaggacaaagaccagtatcagcaggataaaagggagcaacagcgcttcccgtggaatgttctccatgatcatatgttgcaggatacgcgccatgatccaggcctgagcgacaattaatacgccactcatgaaccccaacaggcgggaaatattcaaccaccgttgggagattacgctttgctgttttaaccagcgggtcagctctttttgacgggttttattcattgcacgcttagcaggtgagttattggaatttcaggcagggcaatgttacaacgacgcaaaaataaaggcgacttatagtcgccttttttacttttgttactgatttgtaaaaactatttgctcgcgtcggccagaccatcgagatagcgttcagcatccagcgccgccatacagcccgtacctgcagaggtgatcgcctgacggtaaatatgatccatgacgtcacccgccgcgaatacgccagggatgctggtttgtgtggcgttgccatgggtgccggactgaactttgatataaccattttccagctcaagctggccttcgaagagcgccgtgtttgggctatgaccgatggctacgaaaagtccggcgatgtccagcgtctcgatattatcgctctgctgcgtgtcgcgaagacgcagaccggtgacgcccatctgatcgccggtcacttcttccagcgtccggttggtgtgcagaatgatattgccattttcgactttatccatcaggcgcttaatgaggattttttcagcgcggaaaccgtcacggcgatggataaggtgcacttccgaagcgatgttggacagataaagcgcttcttcaaccgcggtgttgccgccgccgatcaccgctactttctgattgcggtagaagaaaccgtcgcaggttgcgcaggcggaaacgccgcgccctttaaaggcttcttccgatggcagccccagatagcgcgcggaagcgccggtcgcaatgatcaacgcatcacaagtgtactctgcgctgtcacctgtcagacggaacggacgattttgcagatccacgttgttgatgtgatcaaaaattatctcggtttcaaattttgccgcatgttcatgcatgcgttccatcagcagcgggccggtcaaatcgtttggatcgccgggccagttttccacttccgtcgtggtagtcagttgaccgcctttttccataccggtaataagtaccggctgtaaatttgcgcgcgcggcatacaccgccgcggtatatcccgccggtcctgagcccagaataagcagcttactgtgtttggtcgtgcccatgagatccccatagttgttggcagacaatgagcagaattgtagggaatttacagacgtaaaaaaagagcataacgattttgttaacaatatgtgtaatagcatgaaccgatgaacggccgcgacagcgacgttatcatcacaaactttaattaaaatcggtaacttataaggtgacgaaatgacagtttaccgccctctctaatgaataactggcatgttgtactaaaaatcgatgttttgctttgacaatcacctgctgttttgcgaaaacattcgaggaagaaaaaactgtgttatgtatgtgctgcataatcatgcatgtaaataccatgtttaccgggctagtgaaatctacgcatggcgtggacagacgccattcgtgatgtcgatagctgccgcgaggcaacggtcttctcaccatagaccaggcattgcgcgccgttaatccctctgggtttcggtctatcgtgatgggcagcgactctgaacagtgatgtgagtagagtcaggcaggagtagggaaggaatacagagagacaataataatggtagatagcaagaagcgccctggcaaagatctcgaccgtatcgatcgtaacattcttaatgaactgcaaaaggatgggcgtatttccaacgtcgagctttctaaacgagtaggactttcgccgacaccttgccttgagcgtgtgcgtcggctggagcgacaggggtttatccagggctatacggcgctgttgaacccgcattatctggatgcgtcacttctggtattcgttgagattaccttaaatcgcggcgcgccggatgtgtttgaacagtttaatgccgccgtgcaaaagcttgaagagattcaggagtgtcatttggtttccggcgatttcgactacctgttgaaaacccgtgtaccggatatgtcagcgtatcgaaaactattgggagagacgttgctgcgcttgccaggtgtgaacgacacccgaacttacgtagtgatggaagaggtaaaacagagtaatcgtctggttattaagacacgctaacacggaacaggtgcaaaatcgctgtagtttgattacactcctgttaatccatacagcaacagtgccggggcaacccggtgctgttgtccgttttagcatcgggcgggaaaagcctggaacctggagagccttttttgagccaggaatatactgaagacaaagacgtcacattgacgaagttaagcagcgggcgccgacttttggaagcgttgttgatacttattgccctttttgccgtctggttgatggcggccttgttgagctttaacccttcggaccccagttggtcgcaaaccgcctggcatgaacccatccataatttaggcggcgcgccgggcgcgtggctggccgatacactgttctttatttttggcgtaatggcctacaccatccctgtcattattgtcggcgggtgttggtttgcgtggcgtcatcagtctacggatgattacatcgactattttgctgtgtcgctacgccttatcggcgtgctggcgctgattctcacttcctgcggtctggcggccattaatgccgacgatatctggtatttcgcctccggcggcgtaattggcagcctgttaagcaccacgctgcagccgttgttgcatagtagcggcggaacgataatgcttctctgtatttgggctgccgggctgacgctctttaccggctggtcctgggtcagtatcgccgaaaaattaggcggctggctgcttaatatactgaccttcgccagcaaccgtacccggcgtgatgatacgtgggttgacgacgaagagtatgatgacgaatacgatgaagaaaccgacggcgtgcagcgtgaatctcgccgggcgcgtattttgcgcggcgcgttggcgcgtcgtaagcgactggctgaaaaattcagcaatccacggggccgtcagaccgatgccgcgctcttttccggcaaacggatggatgatgacgaggacattcagtatagcgcgcgcggcgtcgctgccgatcccgacgacgttctgttttcgggcaaccgtgcgacgcagccggaatatgatgaatatgatccgctgttaaacggccattctgtcaccgaaccggtcgccgccgctgcggctgcaactgccgtcacccagacgtgggcagcgtccgccgatcccataatgcaaacgccgcccatgcctggggctgagccggttgtcgcgcaaccgaccgtggagtggcagcccgtaccggggccgcaaaccggcgaaccggttatcgcgcctgcgccggaggggtatcagccgcatccgcaatatgctcaaccgcaggaggcgcaaagtgcgccgtggcagcaacctgtgcctgtcgcttccgcgccgcaatacgccgcgacgccagcgaccgcagcagaatatgactctcttgcgccgcaggaaacacagccgcaatggcagccggagccgacccatcagccgacgccggtttatcagccggagccgatagcggctgaaccttctcacatgccgccgccggttatcgaacagccggttgccaccgagcctgaacctgacacagaagagaccagacctgcccgtcctccgctttactattttgaagaggtggaagagaaacgcgcccgtgagcgcgaacaactggcggcatggtatcaaccgattccggagccggtaaaagagaacgtgccggtcaaacctacggtatctgtcgcgccgtccataccgccagtggaagcggtagccgccgccgcgtcgcttgacgcaggtattaagagtggcgccctggcagcaggcgccgcggccgctgcgcctgcatttagtctggctaccggcggcgcgccgcgtccgcaggtgaaagaggggattggtccgcaactgccgcgtccgaaccgcgttcgcgtgccgacccgacgggaactggcatcgtacggtattaagctgccgtcacagaggattgcagaagaaaaagcccgcgaggcggagcgcaatcagtacgagacgggcgcgcagctaaccgatgaagaaatagatgcaatgcatcaggacgagttagcccgtcagtttgcgcagtcgcagcagcatcgttatggtgagacgtatcagcatgatacgcaacaggcagaagatgacgataccgctgcggaagctgaattagcccgccagtttgccgcttcgcaacagcagcgctattccggcgagcaacccgctggcgcgcagccgttctcactggacgatctggatttctcgccaatgaaagtattggttgatgaaggtccgcacgaaccgctgttcacgccgggtgtcatgcccgagtcaacgcctgttcagcaaccggtagcgccgcagcctcagccacagtaccagcagccgcaacagccggtagcgccgcaaccgcagtatcagcagccgcagcagccggtagcgccgcagccgcagtatcagcagccgcaacagccggtagcgcctcagccgcagtatcagcagccgcaacagccggtagcgccgcagccgcagtatcagcagccgcaacagccggtagcgccgcagccgcagtatcagcagccgcagcagccggtagcgccgcagccacagtatcagcagccgcagcagccggtagcgccgcagccacagtatcagcagccgcaacagccgacagcgccgcaagacagcttgatccacccgctgttgatgcgtaacggcgacagccgtccattacagcgtccgacgacgccgctgccttcgttagatcttctgacaccgccgccgagcgaagttgaaccggtagatacctttgcgctggaacaaatggcgcgtctggttgaagcgcgtctggcggatttccgcattaaagctgatgtggtgaactattcgccaggcccggtcattactcgttttgaactgaatctggccccgggcgttaaagcagcgcgtatctccaacctttcccgggatctggcgcgctcattgtcaacggtagccgtacgcgttgtggaagtcattccaggcaaaccttacgtagggttggaattgccgaacaagaaacggcaaaccgtttatctgcgcgaagtgttggataacgccaaattccgcgagaatccgtcgccgcttaccgtggtgttaggtaaggatatcgcgggcgatccggtagtggcggatctggcgaaaatgcctcacctgctggtggccggtacgaccggttccggtaagtcggtcggggttaacgccatgatcctcagtatgctgtataaagcgcagccggaagacgttcgctttatcatgatcgacccgaaaatgttagaactctcggtctatgaaggtataccgcatctgctgacggaagttgttaccgacatgaaagacgcggctaacgcgttacgctggagcgtcaatgagatggagcgtcgctataagctgatgtccgcgctcggcgtgcgtaatctggctggttataacgagaaaatcgccgaagcggcccgcatgggacgtccgattccggacccgtactggaagccgggcgacagtatggatgttcagcatccggttctggaaaaactgccgtatatcgtggtactggttgatgaatttgccgacctgatgatgaccgttggtaaaaaagttgaagagctgatcgcgcgtctggcgcagaaagcgcgcgccgcggggattcacctggtactggcgacgcagcgtccgtcggtcgatgtgattactggtttaattaaagccaacattccaacccgtatcgcttttaccgtatccagcaagatcgactcccgcaccattcttgatcagggtggcgctgagtcgctgctaggtatgggggacatgctctactccggaccaaactccaccatgccggtacgtgtccatggggcgtttgtgcgtgaccaggaagtccatgcggtggttcaggactggaaagcgcgcggtcgtccgcaatatgtggatggcattacctccgacagcgaaagcgaaggtggcggtggcggttttgacggcggcgaagaattagatgcgctattcgatcaggccgttaatttcgtcactcagaagcgaaaagcgtccatttccggcgttcagcgtcagttccgcatcggctataaccgtgcggcgcgtattatcgaacagatggaagcgcagggtattgtcagcgctcaggggcataacggtaatcgtgaagtgctggctccgccgccttttgagtaaacctgtaagccggatggcgctgtgcaggctgccatccggcaacaaaattcagtattttcttctttcctcatgctgatttttggcctggaatagaaagcaaaaggagctcctggtcgggagtgtcgaaacctgaggaataatgatgaaaaaaatggcaatcgcctgtgcattactttcaagcgttgtagccagcagcgtatgggctgacgccgccagctctctgaaaagccgtctggataaagtgagcagctttcatgccacctttactcaaaaagtcaccgatggcagcggtgccgcggtgcaggagggacagggtgatttatgggttaagcggccaaatctattcaactggcatatgacgcaacctgacgagagtattctggtttctgacggcaaaacgttatggttctataacccgtttgtagaacaggctaccgccacgtggttgaaagatgccactggaaatacaccgtttatgctgattgcccgcaaccaggccagcgactggcagcagtataatattaagcaggacggcgataattttgtgctgacgccgaaagccagcaacggcaatctgaaacagttcaccatcaatgtgggacgcgacgggactatccaccagtttagcgccgtagaacaagacgatcagcgtagcgcctatcagctaaaatcccagcaaaacggcgcggttgatccgtcaaaatttacgtttactccgccgcaaggggtaacgatagacgaccaacgtaagtagaggcgatgagtgagcaatctgtcgctcgatttttctgataatacgtttcaaccgctggccgcgcgaatgcggccggaaaatttagcgcagtatatcggccagcagcatttgctggccgcaggtaagccgttgcctcgcgctattgaggccgggcatctgcactccatgattttatgggggccgccagggacggggaaaaccacgctcgctgaagtgatcgcccgctacgccagcgccgatgtcgagcgtatttccgccgtcacttctggggtaaaagagattcgcgaagctatcgagcgcgcccgccagaatcgtaatgccggtcgccgtaccatcctgtttgtcgatgaagtgcatcgctttaacaaaagccagcaggacgcctttttaccgcatatcgaagatggcactatcacctttatcggcgcgaccacggaaaatccctcttttgagctgaactcagcgctcttgtcgcgagcgcgggtctatctgctgaaatcgttgaccactgacgatattgagcaagtactggaccaggcgatgcaggacaaaacgcgtggttacggcgatcaggatatcgtgttaccggatgagacacggcgagcgattgctgagctggtcaatggcgacgcgcggcgcgccttaaatacgctggaaatgatggctgatatggcggaggcggatgacagcggcaaacgcgttttattgcccgccttgttgaccgagatcgccggcgagcgcagcgcgcgttttgataacaaaggcgatcgcttctacgatcttatttccgccttacataaatcagtgcgcggcagcgcgccggatgccgccctctattggtatgcccgtatcattactgcgggaggcgatccgctgtacgtggcgcgtcgctgcctggcgattgcctcggaagatgtgggtaatgccgatccgcgcgcgatgcaggtcgccattgccgcgtgggattgtttcacccgcgttggcccggctgaaggcgaaagggcgatcgcgcaggctatcgtttatctcgcctgcgcaccgaagagcaacgccgtctataccgcctttaaggctgcgctggccgacgcgcgcgaacgtcctgattatgacgttcctgtccatctgcgtaatgcgccaaccaaactgatgaaagagatgggctatggccaggagtaccgctatgcccacgatgagcccaatgcctatgctgcgggtgaagtgtacttcccgccggaaatcgcgcaaacgcgctattatcatccgacaaatcgtggtctggaaggcaagattggcgaaaagctcgcctggctggctgaacaggatcaaaatagccccacaaaacgctaccgctagtgtaaacgttgcggtaaggttatctctaaatatgatgctccaggtatcatggcgttgatgatgaatctcgttatgcctgatagcacgttgcttatgaggtccgcgggtatagcgcaatggatgcgttgttgctgtcgtcggtctggtaaggcgaaaacgtcgctattacgtaaacgcggtttacgttcatcaatacaatcagaggcgatcatcaattgatcgcgtttccttttattattcgataagcacaggataagcatgctcgatcccaatctgctgcgtaatgagccagacgcagtcgctgaaaaactggcacgccggggctttaagctggatgtagataagctgcgcgctcttgaagagcgtcgtaaagttttgcaggtcaacacggaaaacctgcaggcggagcgtaattctcgatcgaaatccatcggccaggcgaaagcgcgcggggaagatatcgagcctttacgcctggaagtgaataaactgggcgaagagctggatgcggcgaaagccgagctggataccttgctggcggagatccgcgatatcgcactgaccatcccaaacctgcctgcggatgaagtgccggtaggtaaagatgaaaacgacaacgttgaagtcagccgctggggtaccccgcgtgagtttgattttgaaatccgcgatcacgtcaccttaggggaaatgcactccggcctcgactttgccgccgcggttaagctgaccggctcccgttttgtggtgatgaaaggacagattgcgcgtatgcatcgcgcattgtcgcagttcatgttggatctgcatacggaacagcacggctatagcgaaaactacgtgccgtatctggttaaccacgacacgctgtatggcaccggtcaattgccgaaattcgcaggcgacttgttccatacccgtccgctggaagaagaagcagacagcagcaactatgctttgatcccgacggcggaggttccgctgaccaatctggtacgcgatgaaatcatcgacgaagatcagctgccgattaaaatgacggcgcatacgccttgtttccgttctgaagcaggttcttatggtcgtgatacccgtggcctgattcgtatgcatcagtttgacaaagttgagatggtgcagatcgttcgcccggaagattctatggctgcgttggaagagatgaccggccacgcggaaaaagtgctccagctactgggactgccgtaccgtaaaatcattctgtgcactggcgatatgggcttcggcgcctgcaaaacctatgacctcgaagtctgggttccggcgcagaatacctaccgcgagatctcttcctgctctaacgtctgggacttccaggcgcgtcgtatgcaggcacgttgtcgcagcaagtccgacaaaaagacccgtctggtccataccctgaatggttctggtctggcggtaggtcgtaccctggtggctgtgatggaaaactatcagcaggctgatggccgcattgaagtgccggaagtattacgtccgtacatgaacggactggaatatatcggctaatcctcgctttctcctcttctaaaaagcgccttcgggcgctttttttatgccagtttgataccggacaataatccctaccctattaggggtaatactgatttcgaatgaaggtcagtttttaacactatttttctactttttcgatatatatcagactttatagcgatgctatcgctatataaaattctatacatcgttttattgtttttttattgtgagcagcagagtgagcccttatgaaaactaagatccctgatgccgtgctggcagccgaggtgagccgtcgtggtttagtcaaaaccaccgcgataggcggcctggcgatggccagtagcgcatttaccctgccatttacccgcatcgctaacgccgcagaggcaataagcccggcgaaaaccggcgagaaagtcgtctggagcgcctgtacggtaaactgtggcagccgttgtccgctacgtatgcatgttgtggatggcgaaatcaaatatgtagaaacggataataccggaaacgatgattacgatggcctgcaccaggttcgcgcctgcctgcgcggtcgttctatgcgccgtcgcgtctataacccggatcggctcaagtatccgatgaagcgcgtcggcgcgcgcggcgaaggtaaatttgagcgtattagctgggacgaagcctacgatatcattgccaccaatatgcagcgtcttatcaaagagtatggcaacgagtccatttatctgaactatggcacgggaacgctgggcggcactttgacacgttcatggccgccaggaaaaacgctggtcgctcgtctgatgaactgctgcggcggttatcttaatcactacggtgattactcttccgcgcaaatcgcagcgggtctgaactacacctatggcggctgggcggatggcaatagtccgtccgacattgaaaacagtaagctggtggtattgtttggcaataaccctggcgaaacccgcatgagcgggggcggtgtaacgtattatcttgaacaggcgcggcagaaatcaaacgcgcggatgatcattatcgaccctcgttacaccgacactggcgctggtcgcgaagatgagtggattccgattcgtccaggtaccgatgcggcgctggtcaatggtctggcatatgtcttaatcaccgagaacatggtcgatcagccgttcctggataaatattgcgttggttatgacgaaaaaaccttgcctgccagcgcgccgaaaaacggtcactacaaagcctatattctgggccagggtaaagacggtatcgcgaagacgccggagtgggcggcgcaaattaccggtatcccggcggatcgcattattaagctggcgcgagaaatcggcagcgctaaacccgcctatatttgccagggatggggaccacaacgtcatgctaatggagaaatcgccacgcgcgccatctcgatgctggcgatcctgacgggtaatgttgggattaacggaggtaatagcggcgcgcgcgaagggtcttatgccctgccatttgaacgtatgcccacgttagaaaacccggttgaaaccagcatctccatgtttatgtggaccgatgccattgaacgcggcccggaaatgacggcgctgcgtgatggcgtgcgggggaaagataagctggacgtgccgatcaaaatgatctggaactatgctggcaactgtttgattaaccagcactctgagattaaccgcacccacgaaatcctgcaggatgacaagaaatgcgaaatgatcgtcgttatcgactgtcatatgacctcgtcggcaaaatacgccgatattctgttgcctgattgcactgcttctgagcagatggactttgcgctggatgcctcctgcgggaacatgtcttacgttatcttcactgaccaggcgattaaaccgcgcttcgagtgtaagacgatttatgagatgaccagcgaactggcgaaacgtcttggcgtggaacaacagtttaccgaaggacggacgcaagaagagtggatgcgtcatctgtacgaacagtcgcgtaaatccattccgaatctgcccacctttgaggagttccgtaagcaaggcatcttcaaacagcgtgaccccgaaggccaccatgtcgcctataaagacttccgcgaagatccgcaagcgaatccacttacaacgccatcgggcaagattgaaatctattcacaggcgttggcggatatcgccgccacctgggagctgccggaaggcgacgtgatcgatccattaccgatctacacgccaggttttgaaaactataacgatccgctaacggataaattcccgctgcagttgacgggtttccactataaagcgcgtgtacattccacttatggcaacgtagacgtactgaaagccgcctgtcgccaggaaatgtggattaacccaatggatgcgcagaaacgcggtatcaacaatggcgacaaagtccgcatcttcaacgatcgcggcgaagtacatatcgaggctaaagtgacgccgcgcatgatgccgggcgtggtcgccctgggagaaggcgcatggtatgacccggatgcaaaacgcgtggatcagggcggatgtattaacgtactgacgacccaacgtccttctccgctggcgaaggggaacccgtcacatacgaacctcgttcaggttgaaaaggcgtaaggagtaaccgatgacaacccagtatggattttttattgattccagccgttgcaccggttgcaaaacctgcgaactggcctgcaaggactacaaagatttgaccccggatgtcagcttccgccgcatttatgagtatgcgggcggcgactggcaggaagataacggcgtctggcaccagaacgtctttgcctactatctctccatctcctgtaaccactgcgaagacccggcctgcaccaaagtctgcccgagcggcgcgatgcacaagcgcgatgacggttttgtggtggtgaacgaagaggtctgtatcggttgccgctactgccacatggcctgcccgtacggcgcgccgcagtacaacgcggccaaaggtcatatgaccaagtgcgatggctgttatgaccgggtggcggaaggtaagaaaccgatttgcgtcgaatcctgcccgctgcgggcgctggactttggtcctatcgatgaactgcgcaaaaaacacggtgagctggctgccgtcgcgccgttgccgcgcgcgcatttcacgaagccgaatattgtgattaaacccaacgccaacagccgcccgaccggggacaccaccggttatctggccaatccgaaggaggtataagatgggaagtggatggcatgaatggccgttgatgatcttcacggtctttggtcagtgcgtggccggtggttttattgttctggctctggcgctgatgaagggcgacctgcgcgcggaaacgcagcagcgggtgatcgcctgtatgtttggtctgtgggtgctgatggggattggctttatcgcctcgatgctgcatctgggctcgccgatgcgcgcgtttaactcgcttaaccgcgtgggtgcttccgcactgagcaatgaaattgccagcggctcggtgttttttgcggtcggcgggatcggctggctgctggcggtactgaaaaagctgccgccggcactgcgcacactctggctgattatcacgatggtactgggcgtcgtcttcgtctggatgatggtacgcgtctataacagcatcgatacagtaccgacctggtatagcgtctggacgccgctgggcttcttcctgacgctctttatgggtggcccgctactgggttatctgctgctgcgcatcgcgggcgtgaacggttgggcgatgcgtttgttgcctgcggtttcggtgctggcgctggtggttattgccattatggtggccatgcagggcgcggaactggcgacgattcacagttccattcagcaggcgtctgctctggtgccggattatggttcgctgatggcctggcgtatggtgctgcttgcggcggcgttgtgctgctggattgtgccacagttaaaagggtatcaacctgcggtaccgttgctctctgtcgccttcattctgatgctggcgggggaattgattggccgcggcgtattctatgggctgcatatgaccgtgggcatggcggtagccagttaacgcgttgacgcgcattcggcctgcagaacgtgcaggccgaattcgcctttagccgccatcaatctaaggaatataaccggggcggagaaggcgcatataaatccatagagaagaaaacgaagctaaaggaaccatgaaatttttcgactgaacaaaacgccgattttgcgggttagattaataaaaacaagaggatgaatttttagcctttcaatatattcacgcgcagaataagtaaatcaaatcgatagtctcaaaacttgcggatcgcccatgcggagccgattgacaatgtttttggcgatggcatgatgcgcatgaaatttgaacttcctcacggtttttattcatgtccacctatacccgtcccgtcatgcttttgctgtgcgggctacttttgttgactctggccattgcggtactgaatacgcttgtgccgctgtggcttgctcaggcaaaccttccgacctggcaggtggggatggtcagctcgtcttattttaccggcaatctggtcgggacgttatttaccgggtatttaattaaacgcattgggtttaaccgtagctattatcttgcctcgctgatcttcgccgcgggttgtgtcggattgggggtgatggtggggttctggagctggatgagctggcgttttattgccggtatcggctgcgccatgatttgggtggttgtcgagagcgcgttgatgtgcagcggaacctcgcataatcgcgggcgcctgctggctgcctatatgatggtctattatatggggaccttccttggacaattattggtcagtaaagtatctggtgaattgctgcacgttcttccctgggtgaccggaatgattctggcgggaattctgccgctactctttacccgaattgtaaatcagcaaacgcaggcacgtcattcctcttctattagcgccatgctgaagctacgccaggcgcgtcttggcgtgaatggttgtattatttccggcattgttcttggttcattatatggcctgatgccgttatatctgaagcatcaggggatggctaacgccagcatcggtttctggatggcggtgctggtgagtgccggtattttggggcaatggccaatgggacgtctggcggacaaatttggtcgcttgctggtgttacgcgtacaggtattcgttgtcatactcggcagtattgccatgttaacccaggcggcgatggcgccagctctgtttattctgggggcggcgggttttacgctttatcccgttgcaatggcctgggcctgtgaaaaagtcgaacaccaccagcttgtggcaatgaaccaggcgctgttgttaagttatacggtagggagcctgttggggccgtcttttgctgcgatgttaatgcagaattattcagataatctgctgtttattatgatcgccagcgtatcgtttatttatctgctgatgctgttacgtaacgccggccagacgcctaatcctgtcgcccacatctgactgttctctgaatcgtatgcaggacgtgagtcttgcatactctttgtttatgttttacgtgaaataattgacctgcataattttcttgctttactgaaaaataaaatgtgccgaaggttataattttgcgctcctctattttctctcttcgtctttaccgcgcataattccccgcttcatttatagtaatagcattgtgttcacgaaggatcgcgttatgccgaatgtgcaggaaaaacagttgcgatggtacaacatcgccttgatgtcgtttattaccgtttggggattcggcaatgttgtcaataactatgctaaccaggggttagtggttgtcttctcctgggtgtttatttttgcgctctattttattccttatgccttaatcgtggggcaactgggctcaaccttcaaagagggaaaagggggcgtcagtacctggattaagcatacgatggggccggggttggcttaccttgcggcatggacttattgggtcgtgcatattccctacctggcgcaaaagccgcaggcgatactcattgcattgggatgggctttaaaaggcgacggctcgttgataaaagaatataccgtcgttgccttgcaggggctgacgctggcattgtttgttttctttatgtgggttgcttcccgggggatgaaatcgctaaaggttgttgggtctgtggccggaattgccatgtttatcatgtcaattttatatgttgtgatggcagtgaccgcgccagcaattacaaacgttgaaattgcgaccactaacatcacctggcagtcatttattcctcatatcgattttacctatatcaccaccatctctatgttggtctttgcggttggtggggcagagaagatctcgccttatgtcaaccagacgcggaatccaggaaaagaatttccgaaggggatgctctttttagccgtcatggttgcggtctgcgctatcctcggttcgttggcgatgggaatgatgtttgattcccggcatatacctgacgatttaatgaccaatgggcaatattatgcattccagaaattgggtgagtattaccatatgggtaattcattaatggttatttatgccattgccaatactctggggcaaatcgccgcgctggtgttttctattgatgcgccactgaaagttttactgggtgatgcagacactaaatatatcccgcagcgcttatgtcgtactaacgcttcaggtacgcctgttaacggttatttgctgacattagtgttggtcgctatcttgattatgttgccaacgcttggcatcggcgatatgaacaacctgtacaaatggctgcttaatctcaattcagtcgttatgccgctgcgctatctgtgggtatttgtcgcctttattgccgtcattcgactggcgcaaaagtacaaacccgaatatgtgtttattcgcaaccgggcgttggcgttaactgtgggaatatggtgttttgccttcaccgcgtttgcctgccttaccggtattttccccaaaatggaggcgttcacgccggagtggacattccagctgacgttgaacatcgtgacgccttttgtcctggtcgggttgggattaattttcccactgctggcgcgtagaaacacataacgacgctcttttccacggcgctcctgtcaggcgagcgccttttaaggttacaggtgcctgggttccaggcggagaccacggtattaacaggcgccgggggcagcaatagttgtcagaccttcaacccagcagcagataagcgactctgtatttaatacctggttagcgcaatattgttaaccatgcctgtctgatggcggggtcgggtattttagcggtaagagcgttatccagacagcaaaacggctaccgtcatgggtagccgtttaaaagcgggtaagatagcaggcgattaatacatcactttatgaccatactgctcaagaataccctttacacgctccatggtctcttttttaggcggcttcacgccatccagtttatattcttcgcccattgccacccatttatgtttgcccagctcatgatagggcaacagttcgattttttcgacattacccatatcgcgggtaaactcgcccaggcgatgcgcggaatcatcgtcgtcagaccagccgggaacgacaacgtaacggatccagaccttcacatttttctttgataaatactgcgcgaattccagcgtccggtgattagagacaccgaccagattctggtggatctcatcattcatctgcttgagatcgagcatcaccagatcggtaacgtccaacagttcatcaatcaccgggtcataacggcgcacaaagccgttggtgtcgagacaggtgtggataccttcttttttacaggcgcgaaaccagtcgcgtacaaattctgcctgcaaaatggcctcgccgccggatgccgtcacgccgccgccagaagcattcataaaatgccgataggtcaccacctctttcattaagtcttcaacggtgatttctttaccgccatgcgtatcccatgtgtcgcggttatggcaatacaggcagcgcatcaggcagccttgaaaaaaggtaataaagcggatgcctgggccatcaacggtgccacaggactcaaaggagtgaatgcgaccaataaccggctttttatcagcagttactgcaacactttcatttgtaatacaattggttaagttactcatatcgcttcggctagctctaaataacatggggtttatggacacattccgggcatgttgagcaccctggtaagggggttgcatcctgtaaaaaagcggtactgcgagcgtaaattttggactacagaatgtgtggctgttccagaatgtgctgcaatggagctattttacctctattcagtataaaatatacggcaaatctatgctgcataactcgcaccgccagaaattctggctcattcatcagctcgtaacgcctcaaccgcaatacatactgcaagtgtatcatccatagcgccctggttttactgtttatgatccgcctcttttttcgaatggttggcgccgttttgttgtggtcagaacgaaaataattctcaacataattcagatgtgtccaaagaacgttatgcgctgtccagcgcctggcgtcgcattcaacgcgcaatcaggtgtaaatctgatgtcatttctaaacccaggctgattcaatctcttaaatagagtgtggttttaatcaaaaaatgagagcaacggattggatcttgctttcgcggtaaataatcaagggagttattatgccagttacgttaagttttggtaatcgtcataactatgaaattaatcattcacggctagcccgtttgatgagtcctgataaagaagaagcgctatacatgggggtatgggatagatttaaggactgcttcagaacacacaaaaaacaagaggtgctggaggtattatatacactcatccatggatgtgaacgtgaaaatcaagctgaacttaatgttgatataaccggcatggagaagatacatgcctttacacaattaaaagaatatgctaatccatctcaacaagaccgctttgttatgcgttttgatatgaatcagacacaagttttatttgagattgatggcaaggttattgataaatgtaatttgcatcgtctcctcaatgtttcagaaaactgtatttttaaagtgatggaagaagatgaagaagagttgtttcttaaaatatgtattaagtatggagaaaaaatttctcgctatccagaattattagaaggatttgctaataaacttaaagatgcagttaatgaggatgatgacgttaaggatgaagtttataagcttatgcgatctggagaagatcgaaaaatggaatgtgttgaatggaatggtactcttactgaagaggagaagaataaactacgctgtcttcaaatggggtcttttaatattactacccaattttttaaaataggttactgggaattagagggggaagtcctgtttgatatggttcatccaacacttagctatctgctacaagcatataaaccgtcattgtcatctgatttaatagaaactaacaccatgctgttttctgatgtattaaataaggattatgatgattatcaaaataataaaagagaaattgatgctattctaagaagaatatatagatcacataataacactttatttataagtgaaaagtcgagttgtcgcaatatgcttatataaaaagtcattaaaaaggccccactgatatggagccttttttgtacgctttttatggcgtaatttcagtcaaacccattacatggtctgcgtgaaggtacgagtaataacgtcctgctgctgttctttcgtcagggagttaaaacgtactgcgtaaccagatacacggatggtcagctgcggatatttttccggatgttccatcgcgtccagcagcatttcacggttcatgacgttgacgttcaggtgctgaccgccttcgatggacgcttcgtggtggaagtaaccatccatcagacctgccaggttagtcttacgaacttcgtcgtctttacccagtgcgttcggaacgatagagaaggtataagaaataccatctttcgcgtaagcaaatggcagtttagcaacggaggtcagagaagcgacagcgcctttctggtcacgaccgtgcatcgggttagcacctggtccgaacggcgcgccagcgcgacgaccatccggggtgttaccggttttcttaccatacacaacgttagaagtaatggtcagaacagactgtgtcgggatagcgccacggtaggtggtcagtttctgaattttcttcatgaaacgttctaccaggtcaaccgccatgtcatctacacgagcgtcgttgttaccaaactgcgggtattcgccttcgatttcgaagtcgatagccagaccatcttcgtcacgaatcggtttaactttcgcatatttgatggcagacagggagtcagcagcaacggacagacctgcgataccacacgccatggtgcggataacgtcacggtcgtgcagcgccatcagagaggcttcgtagctgtacttgtcgtgcatgtagtggataacgttcagcgcggtgacatactgtttagccagccagtccatgaagtgatccatgcggtccatcacttcgtcgaagttcagaacatcgcctttgatcggttcggatttcggaccaacctgcattttcagtttttcatcaacgccgccgttgatagcgtacagcatggttttcgccaggtttgcacgcgcgccgaagaactgcatttgtttaccaacgatcatcgggcttacgcagcatgcgatagcgtagtcatcgttgttgaagtccggacgcatcaggtcatcgttctcgtactgcagagaagaagtgtcgatggagactttagcggcgaatttcttgaagttcagcggcagtttttcagaccacagaacggtgatgttcggctccggagacggccccatggtgtacagggtgttcaggaaacggaagctgtttttggtgaccagagtacggccatcaacgcccataccgccgatagattcggttgcccaaatcgggtcgccggagaacagttcatcatattcaggagtacgcaggaagcgaaccatacgcagtttcatgaccaggtggtcaatcatttcctgtgcgtcttgctcggtgattttgcctgctttcaggtcacgttcgatgtacgcatccaggaaggtggatacacgaccgaaggacattgctgcgccgttctgagatttaaccgcagccaggtaaccgaagtaagtccactggattgcttcctgagcgttagtcgccggaccagagatatcgcagccgtatttagctgccatttctttgatctgacccagagcgcggtgctgttcagcgatttcttcacgcagacggatagtcgcttccagatttacgccgttttccagatcggattgcagagacgtaaactgtgcgaatttgtctttcatcaggtagtcgataccgtacagcgctacgcgacggtagtcaccgatgatacggccacggccatacgcatccggcagaccggtcagaacgccggatttacggcaacgcaagatgtccggagtataaacgtcgaacacgccctggttgtgagtcttacggtattcggtgaagatttttttgatcattgggtccagctcgcgattgtacgctttgcaggaaccttcaaccattttgatgccgccgaacgggataatcgcacgcttcagcggagcttcagtctgcagaccaacaattttctcaagcgctttgttgatgtagccagcgtcgtgagaagtgatggtggaagcaacggaggtgtcaaagtcaacaggcgcgtgagtgcggttttcctgtttaacgccttccattacgctgtcccacagcttggtggtcgcgtcagtagcgccagccaggaaggactcgtcaccctcatacggagtgtagtttttctgaatgaagtcacggacgtttacttcattctgccagtcacctttggtaaaaccttcccaggctgtggctaacttttcattaagctcggacatgtaacacctaccttcttaagtggattttttatttactgcgtgtaatgggcatcaacagattaatgatgctcgttaccacgcaggtaaatgacccagtatgtcaacccgaccaacaaaccgccgccgataatattaccgatcgtgaccggaatcaggttatcagtgatgaagctcatcacggtcaggtgagaaaaactttccggagacgaaccaaccgcggtccaaaactccggtgtagcaaaatcgcgtattacaatacccataggaatcataaacatgtttgcgatactgtgctcaaaaccgctggcgacaaacatggcgacgggcagtaccatgatgaacgctttgtccatcaggctacgacctgagtagctcatccacacggccagacaaaccatcaggttcgccagaataccgaggcagacagcttcaataaaagtgtggtgcattttgtggtcggcggtttgcaggacgttaagtccccattgaccgttggcagtcatatactcgccggaaagccacatcagtaacacgaaaagcagagcgccaatcaggttaccaaaatagacgtttaaccagtttttagccagttgcccccaggtgatgcgaccgctagctttagctacaacgatcagaacagtagaggtgaagagatcagcgccgcaaataacacagagaatcagtcccaaagagaaacagatacccccgataagtttcgccatgccataaggcatcgcgccagtaccggttgtcgcagtaatataaaaaacaaaggcaattgaaatgaatacgccggcggtaatcgccagatagaaagtcttaagcggatgtttcgttgctttatagacgcctgcttcttcagccactttggccattgctgcagggagtaaaaggtcaaaagggttgtcagctttcacactaactctctctttattaagtcggcgacgagatactaacaaagcattatagatgagaatttgatatagatcatatctcgcctggcttataggcccgtaagtcgcatggcttttatgcaattacggtgtaactttttgattatcctaataaaaataaattttaaaaattataaatagagttgaattttttcctgactcctcctgctgcacggttaattaatatggagtaatcaacaaataaagtaacatcactatgtcaattaatttaatatcaacaaccaatatttaaccttgttattacatttttcgccgtttagcgaaaataaataaaacggggccgcaaaggcgccccgtaatataacgcagccgagagggtaaacctaccctaagtcactcatatggccttattttgaccagtatgccgctttcgcgcgctgtaatttatcatacgcttttaacaaggactgatgcgccgggaacgcttgtagatcgtggtcgacagccggtagtccataaaaagccgcttcaccgctaagcgcggcgctggcggcctctacagcctctgcgccatacatttttataaaagcattgagatattgcagtggctgacgcgcatcttcttgcgacaggagcagcagagtttgcaggcaacggtaatagtttgcgcgtgtcggactaaagaccgacgaattgaactccatcgtccattctgtccagattagcgcctgctccaaatcgccgcccgctaacgctaacattgcttttaattcgccgacgcgcagtgtataccaaccattgtccgctccggtcgccagacccaacagttcacgcacgcgggtgaaatcgtcaaaaccttcttcatccaattgttcaatcagattgagataatcttctttattccaggcgctaccgggcagcgaaagcagagtctcacgaagatggctacccatattgttgttggccagccacagatcttcggcaggataaatatcagacattcccggtacgataatacgacaggcgtatacgccgagatgctcgtaatcggcaatgtaaacttctttatcttcagcagcaaagatggccatcagcgtggcgaattcttcttcggtagtgccggaaaaactccagtccgtgaacggataatcggcgtcctgtttgaacagatcccaggaaatcaggccgctggagtcgatgaagtgggtctccagattagtgtgctccgcgacttcttcatcatcgaacgttggtggcgtgaagacatcaagatctttcagaccgcgtccctggagtagctcggtcactgtacgctccagcgcaacgccaaagtcaggatgggcgccaaaagaagcaaagcaggtaccgttagccgggttgaacagcacgacgcagataaccggatacttaccgcccagcgagccgtcataggcgaaaatcgggaaaccctcggcttccagcgtggcgattgactccattaccgccggataacgcgccatcacctctgcgggaatctccggcagactgatactttccgcaatgatgcgatttttcacataacgctcgaagacttccgacagtccctgaacgcgggcttcattacgcgtattgccggcggacattccgttagagacgtacaggttgccgatgatattcatcggaatatacacggtctggttatcggactgacgggtaaatggcaggccgcagacgccgcgagcttcattgccggactgaagatcaattaactggcttccggtgagttcattttccggatcgtaaaacgcgcgcagacgggcatcaagcaagccttccggtacgtcgtcattttcagtcagcgggaaccacttttcgttcgggtaatgcacgaatggcccattggcgaccgtttcgccaagccagaaatcagcaaagaagtagttggttgacagacgctcgaagtattcgcccagcgccgaggccagcgccgcttttttggtcgcgccttttccgttggtaaagcataacgcgcactctttatcgcgaatatgcactgaccagacgtttggcaccgggttcagccaggaggcctcttcgatgtgaaagccgaggtcgagtaacttttgctggaagcgggcgatggagtcttccagcgcggcgtctttgccgggaataaatgtttgcgtcatgaaaatcacttttgtcgtacggaaagcgcgcaatgatacgggttttatgtgacgggcgctatctcgccgggacatcggcggaaataaaagtattggctatgcttttacactggcattcacaggaagagcataaaaaatgaaagcatttgatttgcaacgaatggcgctggataacgtgccggtagcgtttttgggggaagtggcgctgcgtagcttttacacctttgttctggtgtttcttttcttaaaggtgacaggacgacgcggcgtacggcaaatgtcgctttttgaagtgctgatcattttgacattggggtcggcggcaggcgacgtcgcgttttatgatgacgttccgatgctccctgttctggtggtattcatcaccctggcgctgctctatcgcctggttatgtggctgatggcgcatagtgaaaagttggaagatctgctggaaggcaagtcggtggtcattgttgaagacggcgaactggcgtgggaaaaactgcagcgctcgaacatgacggagtttgagttttttatggagcttcgcttgaatggcgttgagcaactggggcaggtcagactggccatcctggagacaaacggacaaatcagcgtctatttctttgaaaataaagacgttaagccggggttaagcattcttcctgagcactgtacgccacgctttatcgtggcgccggaggctggcgactatgcctgcgtacgttgcagtgaagtgatacgcatgaacgccggggaaaagcaattatgtccgcgctgcgcaaatccagaatggacgaaggcaagccgggctaaacgcgttgtttaacagcgaaaatatcggatttatacggttaatccggaagattctgttgtgtgacgcatgccgcattttctcctcgcattgttttacccattgcggcgcgtgtcactgaatgataaaaccgatattcacatgaataacgtttgcctgatgtctgtcaggcaggaaacaatgcagcgtggtgaggggaaatggctcaggtctttaattttagttcaggtccggcgatgctaccggcggaagtacttaaactggcgcaacaggaactgtgtgactggcacggtcttggtacgtcggtaatggaaattagccatcgaggcaaagagtttatccaggtcgctgaagaggcggagcaggattttcgcgatctccttaatatcccctccaactataaagttttattttgtcacggcggcggtcgcgggcagtttgctggcgtgccgctcaatctgctgggcgataaaaccacggcggattatgtcgatgccggttactgggcggcgagcgccatcaaagaagccaaaaaatactgtgcgccgcagattatcgacgccaaaatcaccgtggacggcaaacgtgccgtaaaaccgatgcgcgagtggcagctttccgataatgccgcttatttgcactattgcccgaatgagaccattgacggcatcgccatcgatgaaacgccggattttggcccggaggtggtcgtcacggcggacttttcttctaccatcctgtctgcgccgctggacgtctctcgctatggcgtaatttatgctggcgcgcagaagaatatcggtccggcaggactgacgctggttatcgtccgggaggatctgttaggcaaggcgcatgagagctgcccgtccatcctcgactacaccgtcctgaatgataacgactcgatgtttaatacgccgccgactttcgcctggtatctttccggtctggtgttcaaatggttgaaagcgcagggcggcgtggcggcgatgcacaaaatcaatcagcaaaaagcggagttgctgtacggtgtgattgataacagcgatttctaccgtaacgatgtcgcacaggccaaccgttcgcggatgaatgttccgttccagttagcggacaatacgctggacaaggtctttctggaagagtctttcgccgccggtctgcacgccttaaaagggcaccgtgttgttggcggtatgcgcgcctctatctataacgccatgccgattgaaggggtaaaagcgctgaccgatttcatgatcgattttgagcgtcgccacggctaatacgtttcttttttcatccccacggccagtctgtggggtttttatttctgttttttgagagttgagtttcatggaatccctgacgttacaacccatcgcgcgggtcgatggcgccattaatttacctggctccaaaagtgtttcaaaccgtgctttgctcctggcggctttagcttgtggtaaaaccgctctgacgaatctgctggatagcgatgacgtccgccatatgctcaatgccctgagcgcgttggggatcaattacaccctttctgccgatcgcacccgctgtgatatcacgggtaatggcggcgcattacgtgcgccaggcgctctggaactgtttctcggtaatgccggaaccgcgatgcgtccgttagcggcagcgctatgtctggggcaaaatgagatagtgttaaccggcgaaccgcgtatgaaagagcgtccgataggccatctggtcgattcgctgcgtcagggcggggcgaatattgattacctggagcaggaaaactatccgcccctgcgtctgcgcggcggttttaccggcggcgacattgaggttgatggtagcgtttccagccagttcctgaccgctctgctgatgacggcgccgctggcccctaaagacacaattattcgcgttaaaggcgaactggtatcaaaaccttacatcgatatcacgctaaatttaatgaaaacctttggcgtggagatagcgaaccaccactaccaacaatttgtcgtgaagggaggtcaacagtatcactctccaggtcgctatctggtcgagggcgatgcctcgtcagcgtcctattttctcgccgctggggcgataaaaggcggcacggtaaaagtgaccggaattggccgcaaaagtatgcagggcgatattcgttttgccgatgtgctggagaaaatgggcgcgaccattacctggggcgatgattttattgcctgcacgcgcggtgaattgcacgccatagatatggatatgaaccatattccggatgcggcgatgacgattgccaccacggcgctgtttgcgaaaggaaccacgacgttgcgcaatatttataactggcgagtgaaagaaaccgatcgcctgttcgcgatggcgaccgagctacgtaaagtgggcgctgaagtcgaagaagggcacgactatattcgtatcacgccgccggcgaagctccaacacgcggatattggcacgtacaacgaccaccgtatggcgatgtgcttctcactggtcgcactgtccgatacgccagttacgatcctggaccctaaatgtaccgcaaaaacgttccctgattatttcgaacaactggcgcgaatgagtacgcctgcctaagtcttctgttgcgccagtcgacgggctggcgcgccgagtccgtattcgcactatttttataattatgactaatgctaatttgttgatgatttaacacattgatttatgtgttttttataatagttatcaacggaagattagtatgaaaaataaatcattactactggcggtggcgatttccgccacgctactggcaggatgtaaaaatggcgtgaatggcaatttaatcgccagttcaggcatgtcaacctacaaagccgccacactgtccgatgcggatgttaaggcattatctaataatgcctgtaaacaaatggacagcgagaatcaactggcaggttcgaaaagcaaatacaccaaacgtctgagcaaaatcgccaaagcgctgggtaacaacattgacggtacgccggttagctataaagtctatatgaccagcgatatcaacgcatgggcgatggcgaacggttgcgttcgcgtatactccggcctgatggatctgatgaccgataatgaaattgaaggcgtactgggccatgaactgggccatgtctctttagggcactctcgcaaggcaatgcagaccgcttatgccacgctggcggctcgcgatgcgatttccgccaccagcggcgtcgcagcgcagctttcccagtctcaattgggcgatctggcggaaggcgtcatcaattcggcgttttctcgcagtcaggagtcggatgcggatgacttctcttacgatctgctgaaaaaacgcgggattaacacccagggcttagtcacggcattcgataaattcgccacaatggacgcaggtcatgcaaaatcattgatggactcccacccggcttcagccgatcgcgcgcagcatatgcgcgacagaattgccgaagataaaaagtaaatcattgtcatctttcgggctggtttctcgccggcccgctataattgcgcaattattccgcatctgattacagacaaaactggtttttgcacgcaacgttaacggtcgcgagcgttggcgcgtataatgcgcggcgtttacgttaacggtacgcctgtttaaggagataaagatgacggcaattgccccggtaataaccattgatggcccaagcggtgcaggtaaaggcaccttgtgcaaagcaatggcggaagcattgcaatggcatctgctggattccggcgcgatataccgcgtactggcgctggcggcattgcatcaccatgtcgatctcgcctctgaagatgcgctggtgccgctggcgtcccatctggacgtgcgtttcgtctcaacggacggcaacctggaagttatcctggaaggcgaggacgttagcggcgaaatccgtacgcaggaagtcgcgaacgcggcatcccaggtggcggcattcccacgcgtgcgtgaagcgcttcttcgccgccaacgcgcattccgcgaagcgcctggtttaatcgccgatggacgcgatatggggaccgtggtcttcccggatgcgccggtaaaaattttccttgacgcctcctcggaggaacgtgcgcatcgacgtatgctacagttgcaggagaatggctttagtgttaactttgaacgccttttggccgagatcaaggaacgcgacgatcgcgatcgtcatcgtgccgttgcgccgttagttcctgctgctgatgcattagttttggattctacccgattaagcattgagcaagtgattgaaaaagcgttacaatatgcgcgccaaaaattggctctcgcttaaatgcgaccgaatttgtagtacccccgttgcaaaggattgacagcgggtatgttaaacaaccccatccggcacggagccaggtggacgttaaatatgaaacctgaagattaaacatgactgaatcttttgctcaactctttgaagaatccttaaaagaaatcgaaacccgcccgggttccatcgttcgtggtgttgttgttgctatcgacaaagacgtagtactggttgacgccggtctgaaatctgagtctgccattccggctgagcagttcaaaaacgcccagggcgaactggaaatccaggttggtgacgaagttgacgttgctctggatgcagtagaagacggcttcggtgaaactctgctctctcgtgagaaagctaaacgtcacgaagcatggatcacgctggaaaaagcttacgaagatgctgaaactgttaccggtgttatcaacggcaaagttaagggtggcttcactgttgagctgaacggtattcgcgcgttcctgccaggttctctggtagacgttcgtccggtgcgtgatactctgcacctggaaggcaaagagcttgaattcaaagtaatcaagctggaccagaaacgtaacaacgttgtggtttctcgtcgtgccgttatcgaatccgaaaacagcgcagaacgcgatcagctgctggaaaacctgcaggaaggcatggaagttaaaggtatcgttaagaacctcactgactacggtgcattcgttgatctgggcggcgttgacggcctgctgcacatcactgatatggcctggaaacgcgttaagcatccgagcgaaatcgtgaacgttggcgacgaaatcaatgtgaaagtgctgaaattcgaccgcgagcgtacccgtgtatccctgggcctgaaacagctgggcgaagatccgtgggttgctatcgctaaacgttatccggaaggtaccaaactgaccggtcgcgtgaccaacctgaccgattacggctgcttcgttgaaatcgaagaaggcgttgaaggcctggttcacgtttccgaaatggactggaccaacaaaaacatccacccgtccaaagtggttaacgttggcgacgtagtggaagtgatggttctggatatcgacgaagaacgtcgtcgtatctccctgggtctgaagcagtgcaaatctaacccgtggcagcagttcgcagaaacccacaacaagggcgaccgcgttgaaggtaaaatcaagtctatcactgacttcggtatcttcatcggcctggacggcggcatcgacggcctggttcacctgtctgacatctcctggaacgttgcaggcgaagaagcagttcgtgaatacaaaaaaggcgacgaaatcgctgcagttgttctgcaggttgacgcagaacgtgaacgtatctccctgggcgttaaacagctcgcagaagatccgttcaacaactgggttgctctgaacaagaaaggcgctatcgtaaccggtaaagtcactgcagttgacgctaaaggcgcaaccgtagaactggccgacggcgttgaaggttacctgcgtgcttctgaagcatcccgtgaccgcgttgaagatgcgactctggttctgagcgttggcgacgacgttgaagctaaattcaccggcgttgatcgtaaaaaccgcgcaatcagcctgtctgttcgtgcgaaagacgaagctgacgagaaagatgccatcgcaactgttaacaaacaggaagatgcaaacttctctaacaacgcaatggctgaagcattcaaagcagctaaaggcgagtaatcctctgaaacttcgggtcttttagtccgaagtataacgagattacttgacagattgcaggtttcggcctgtaatcaagcactaagggcggctacggccgcccttaatcaatctcacggctgcagccaatttgcctttaaggaaccggaggaatcatgaccaagtcagaattgattgaaagacttgcaacccagcaatctcacattcccgctaaggcggttgaagacgcggtaaaagagatgctggagcatatggcctcgactcttgcgcagggcgagcgtattgaaatccgcggtttcggcagtttttctttgcattaccgcgcgcctcgtaccggacgtaaccccaagaccggcgataaagtggaactggaaggaaaatacgttcctcactttaaaccgggtaaagaactgcgcgatcgcgccaatatttacggttaagttttaacgcaaaacttgaacccgaaaaaagcaccgtcagggtgcttttttcatttatacgccgtcaggcgcaaacgctattcgaccgaaaactggaaaacgtttcgcattttttgctgcgtcttacatttatcaggtaaaaaacctggaatccgcgccgtatagcacaaaatcccctccagacaatggcgtcctgaacctgcacactttcccgcacagggaggtgtctatgaagataacgacggtcagcgtatgcgtagtatgcggcatacttccactcatgatattgccagtattacctgatacgtggattctcgcggtgctgttttgtctggcatgtttgctttgcctcataccccatcactatgcgcgctacgcggcattaactttgctctttttcatgtgggggatatttgccgccaggcaggccatctgggcgggaaacgtcctgcccgccgcgacgcaggaggcgacagtcgtcattactgccaccgatcatatgaccactcattatgggcgaatcacccatttgcgcggaaagccgctctttcctgctgtagggattgtcctgcatggccagtacttacccacggaagtgtgtgccgggcaacagtgggcgatgacgctgaaggtcagagcggtacacggacagcttaacgaaggcggttttgatagccagcgttacgcgctagcgcagcaccaaccgttgaccgggcgtttcctacaggctaaagcgattaaccctgagtgtagcttgcgtgggcgctatcttgcttcgcttcgcgctacgcttgcgccttatccgtggcagcaggttattctggcgttgggaatgggggagcggggagcggtgtcgcaggaggtgaaggccgttatgcgcgatacggggactgcccatttgatggcgatttccggcctgcatatcgcttttgctgcgttattggctgccggattaatccgtggcggacaattctttttgccggtcagatggattcgttggcagacgccattgctgggcggcattctttgcgcgatatgttatgcctggcttaccggcttacaaccgcctgcgctgcgcacggtggcggcgctgagcgtctggggaggattaaaattaagcggacgacagtggagcggctggcaagtctggtgctgctgtctggccgcgattattttcgccgatcctgtggcggttatatcacaaagtctttggctgtcagcatttgcggttgccggcctgttattctggtatcagtggtttcctgcgccaaacggaaattttccacgaggcttacgctggttgcttaacctgcttcacctacaggcaggcattacacttctgcttttgcctctccaggtggcgctttttcatggcataagcgttaccgcaatgctggcgaatctttttgccgtaccctgggtcacatttgtgacggttccactcatcctggcgggaatgattctgcatttaaccgggccgttttttcttgaagagtgggtatggtacctgaccgatcgcgcgttagccgcgctattttacctgttgaatgctttaccgcagggctgggtcaatattgataaccgttggcagtggctgacgcttttaccctggttaacgcttatcgcgtggcgattaaacgtctggcgtacctggccggcggtttgtttatgcgggttattgttgatgagctggccactctggcggccgataaacgccagcggatggcaggtgcatatgctggatgtcggtcaggggctggcgatagcgatcgtcaggggcgataaagtaatactctacgataccggtcgggcatggccggagggcgacagcgggcaacaggttattattccctggttgcgctggcataatctgacgccggagggcgttattttgagtcatgagcatctggatcatcggggcgggctgcgttcgctacagcaggtctggccgtcaatgtggattcgcagcccgttaggctggcagggacatttgccctgttttcgtggcgagcagtggcaatggcaggggctaacgtttcaggcgcactggccgttacgcgaaagtgccgatcgaggaaataaccgttcttgtgtggtcaaagtggatgacggtgtacatagcatcctgctcacgggcgatatcgaagcgggcgctgaacaaaaaatgctaagtcgttactggcgacatcttgcggcgacgtttatccaggtgccgcatcatggtagtaatacgtcgtcgtcgctaccatttattcagcgcgtacatggtgaagcggcgctggcgtccgcatcgcgctataacgcatggcggctgccgtcccgcaaggtaaaacagcgctaccgacagcaggcgtatcagtggtttgatacaccccaccaggggcaaatttcgctgcggttttctccgcagggctggcgcatacaaggcttacgggatcaaattttacctcgctggtatcatcagtggtttggcgtgtccgaggataacgggtagaatatgcggctatttcaacaaatgctggttttttgaatgcataacgataaagatctctctacgtggcagaccttccgccgactgtggccaaccatagcgccttttaaagcaggtctgatcgtggcgggcatagcgttaattctcaacgcagccagcgataccttcatgctatcgctcctcaagccattactggatgatggtttcggtaaaacggatcgctcagtgttgctgtggatgccgctggtggttattgggctgatgatattacgaggcatcactagctatatctccagctactgtatttcatgggtgtcaggcaaggtggtaatgaccatgcgccgtcgcctgtttggccatatgatgggaatgcccgtcgccttctttgataaacagtctaccggtacgctgctgtcgcgtattacatacgattcagaacaggttgcctcttcttcatctggcgcgctgattaccgtggtgcgtgaaggggcatcgatcatcggattgtttatcatgatgttctattacagctggcagttgtcgatcatcctggttgttttagcgccgattgtgtcgattgcgattcgcgttgtctcaaagcggttccgcagcatcagtaaaaatatgcagaacacgatgggacaagtgactaccagcgctgaacaaatgctgaaaggacacaaagaggtactgatttttggcggtcaggaagtcgaaactaaacgctttgataaagtcagcaataagatgcgactgcaaggcatgaaaatggtctctgcctcgtcaatttccgatcctatcattcagctcattgcctcgctggcgctggcgtttgtcctctatgctgcgagcttcccaagcgtaatggatagcctgacggcagggaccatcaccgtggtgttctcctccatgatcgcgctgatgcgtccattaaaatcgctgacaaacgttaacgcgcagttccagcgtgggatggcggcttgtcaaacgttgtttgcgattctggatagcgaacaggagaaagatgaaggtaaacgtgtcattgaccgcgcgaccggcgatctcgaattccgcaatgtgacgtttacttacccgggccgtgaagtgccggcattgcgtaacatcaatttgaaaattcctgccgggaaaaccgtggcgctggtggggcgttccggatcgggtaaatcaactatcgccagtctgatcacccgtttctacgatattgatgaagggcacatcctgatggatggtcacgatctacgcgaatacactctggcctctctacgtaatcaggtggcgctggtttcgcaaaacgtgcatctgtttaacgacacggtcgccaataacattgcttatgcccggacggaagaatacagccgcgagcagattgaagaggcggcgcgcatggcctatgccatggactttatcaataagatggataatggcctggataccatcatcggcgaaaacggcgtactgctttccggcggtcagcgccagcgtatcgcgatcgcccgcgccttactgcgcgacagcccgattctgatccttgatgaagctacgtccgcgctggataccgaatctgaacgtgcgattcaggcagcgttggatgagctgcagaaaaaccgtacctctctggtgattgcgcaccgtctctccaccatcgaacaggcggatgagatcgttgtagtcgaagacggtattatcgttgagcgcggcactcatagcgagctgctggcgcaacacggcgtttacgcccagctacataagatgcaatttggccaatgattgcgcgtatctggtcgggtgaatccccgctatggcggttactgctgccgctctcctggctgtatggcctggtgagcggggcgattcgtctgagctataagcttggttttaaacgcgcctggcgagcgccggtaccggtggttgtggtagggaatcttacggctggcggtaacggtaaaacccccgtagtcatttggctggtggaaaagctgcaacagcgtggcgtgcgcgtgggggtcgtttcccgcggctacggcgggaaagctgccgcttatccgctgctcctgacgccggagacgacaaccgcagaagcgggagatgaaccggtattgatttatcaacggaccggcgcgcctgtcgcggtagcgcctgaacgcgccgcggcggtgaaagcgattctggcagcgcataatgtgcagattattatcaccgacgatgggttgcagcattaccgactcgcgcgagatattgaaattgtggtgattgacggcgtgcgccgttttggcaacggctggtggcttcctgccggtcctatgcgcgaacgcgccagtcgcctgaaaaccgtagacgccgctatcgtgaatggcggcgtcgcccgggcgggcgaaatccccatgcagctagcgcctggactggcggtgaacttacgtacgggagcgcgttgcgatgtggcgcaactgagcaatattgtggcgatggcgggcatcggtcatccgccgcgctttttcgccacgctggaagcctgtggcgcgcatccgcaaaagtgcgtcccgctggccgatcatcaaacgctcgcccctgctgacgttcaggcgttggtcggtgaagggcagaccctggtaatgacggaaaaagacgcggtgaaatgccgtgcttttgccgaagataactggtggttcttaccggttgatgcgcgtttgtccggtgagcagcctgataagttgcttcaacatatcacctcgctggttcgctagcgtcccccaatgcagcggcagtgatgaatttatggagtcatgaatgtcattgccgtacctttctctttcccaggcccgttgtcttcaccttgctgcgcaggggctattgaaaaagccgcgccgtaacgcgctgcctggcgatgttcttgccgccatctcacgcatggcgttgctgcaaattgataccatcaatgttgtcgcacgtagcccctatctggtgctgtttagccgtctcggctcgtacccgcaggcctggctggatgaggcgctgcgacgcggcgagttaatggaatactgggcgcatgaggcctgtttcttaccacgccgtgactttaaacttatccgccatcgtatgctgtcgccggaaaagatgggctggaaatatcacgcggcatggatgcatgagcacgcggaagaaatagaacagctggtgcggcatattcaggagcacggtccggtgcgttctgccgattttgaacatgcgcagaaaggtgccagcggctggtgggaatggaaaccacataaacgccaccttgagggtttatttaccgccggaaaagtcatggttgttgagcggcgtaattttcaacgtgtatatgatttaacgccccgtgtgatgccgcactgggatgatgaacgcgatggactgtcacagtcgcaggcggaaaacctgatgctggataatagcgcgcgcagtctggggattttccgtgaacagtggctggcggattactaccgcctgaaacgtcctgacctgaagggatggcgggagagccgggcggaacagcagcagattattccggtcgaggtggaaacgttggggcggatgtggcttcatgccgatcttctttcgcagctggaaccggcgctgaataacgccttaaaggcgacccatagcgcagtactgtcgcctttcgatcctgtggtatgggatcgcaagcgggcaacgcagcttttcggatttaactatcggctggaatgttatacgcctgcggcgaagcgccagtacggttattttgtgctgccgctattatacctgggccgtttagtcgggcgaatggatgccaaaatgcaccgtaaaacgggggtgcttgaggttatctcgctgtatctggaggacgatattcgccctggcgttagtctgcaaaaaggaatctggcaggcgattagcgcgtttgctgcctggcaacgggcatcgcgcgtgacgctgggacaatgtccgccaggcctgtttagcaccatgcgtcatggctgggaaatagaccctgcaccctaaccgattatgttaatattgaaggattcacaatccggtccatctggaggaactatggatcatcgtctgcttgaaatcatcgcctgcccggtatgtaacggcaaactctggtataaccaggaacagcaagaattaatttgcaaactggacaatctcgctttcccgttacgcgacggcattcctgtattgctggaaaatgaagctcgcgccctgacatctgatgagagtaaatcatgagtttcgtcgtcatcattccggcccgtttttcatctacccgactgccaggcaaaccattagtggatattaatggtaagcccatgattgttcatgtcctggagcgggcgcgcgaatctggcgcggaacgcattattgtcgcgaccgatcatgaagacgtggctcgtgcggtagaagcggctggcggcgaagtgtgcatgacgcgcgccgatcaccagtccggcaccgaacggttggcggaagtggtagagaagtgcggattcagcgacgataccgttattgtgaacgttcagggcgatgagccgatgatcccggcggttattattcgccaggtcgcggaaaatctggcgcagcgccaggttggcatggcgacgctggcggtgccgattcacagcgccgaagaagcgtttaacccgaatgcggtaaaagtcgtgctggatgctgaaggctatgcgctttacttttcccgggcgacgattccctgggatcgcgatcgctttgcaaaaagtctggaaacggtaggggatacttgccttcgtcacctgggcatttatggctatcgcgcggggtttatccgccgttacgtgagctggcaacccagcccgctggaacatattgaaatgctggagcaactccgtgtgctgtggtacggcgaaaaaattcatgtcgccgtcgccaaagcggtgcccggcacgggcgtagacaccgccgacgacctggagcgcgtgcgcgctgaaatgcgttaacatgatcctgttcatgatcgtcttagacggtcatgaacagcgcggtatgatagcgcaaagatgaatactcacgtctgctcatcagtggcggctttctcgtaccgttacgattttcctcatttttcttttcttcccttgatctgatacgggtgacatctgtccatacgacgctcattattaaagcagtagcactaatgggggtaatctggaatggaacagttgcgggccgaactcagtcatttgttgggtgaaaaacttagccgtatagagtgcgtgaatgagaaagcggattccgcattgtggtcattatatgacagccagggcattccgatgccgctgatggcgcgaagttttaccactcccggcgttgcgcagcaactggcatggaaaacctcaatgctggcgcgtagcggtacggtgaggatgccggtaatctatggcgtattgacgcatgaagagcatcctggtccggatgtgctgctgctggaacggctgcgcggtgtgccggtcgaggcgccggcgcgcactccggaacgctgggaacagctaaaagatcagattgtcgaagggctgttagcctggcatcggcaggatagccgcggttgcgttggcgccgtagaccatactcaggagaatatctggccttcctggtatcgtcagcgggtggaggtgctgtggacgacgctaaatcagttcagcaataccggcctgacgatgcaggacagacgcattctgtttcgtaccagagaatgtcttccttcgttatttgaagggtttaacgataactgcgtactggtgcatggcaacttctgcctgcgcagtatgcttaaagacgcccgtagcgatcagcttctggcgatggtcggccccgggctgatgctgtgggcgccgagagagttcgaactgtttcgcctgatggataatccattggcggagggattgctttggcattatctgcaacgcgcgccagtggcggagtccttcatctggcggcgttggctctatgtgctgtgggacgaggttgcgcaattggtcaataccggacgttttaaccgtaccaattttgatcttgcggcgaaatcattactcccctggcttgcctgatatgcctttcagccattgccaaagtcgccctaatgtttcatacccagcgcgatcgctgtgcatcagccagaccggggacggaattgcccgctcccagggattgagcggcgaatcgatcgccaactgattcgccggcgcgggaagcggattcagcccggcatgctgaaagaaaatcatcgcacgcggcaaatgcgaggcggaggttaccaacaggaaaggggcgtcgccgatggcctgcttaacggcggcggcttcttcttccgtatcttttggcttatccagcgtaataatatcgctacgcggtacgcccagtgactgcgccacccgcgcaccgacttccgccgtgcttaccgtattggtttttgctacgccgccggtaaaaatcagcctggctcccggattcgcgcgccacagccgaatgccttccgccagccgcggcaagctgttgttaattaaattagagctcggcgcccactgcgggttccaggtatagccgccgccgagaaccacaatatattccaccttttgcggaccctgccaggtagggtagcggttttctatcggacgcagcagatggtcagagacgggttgcaggcttaatagcaatagcgccagccaacctacgctgataaatacttttccggtcttctgaaagcggctaaaccagagcagcgccaggccgacgccaatcatcagcaacatcagcggaagcggcaataacataccgccaatcactttctttagcgtaaaaagcatcctttttggttccttttttaaccatatagcggaggattaacggtgatattacaccagacaggttcattctggccgcggctgtgacaaaatagcggttttatcagataacgcctgagccagcctgtggagagtccgatgcaggatcgcaattttgatgacattgctgaaaagttttcccgtaacatttacggcacgaccaaaggacaactgcggcaagccattctgtggcaagacctggatcgcgtgctggaggagattggcgggcggaaactgcgggtgctggatgccggcggcggcgaagggcaaacggcgattaagatggcggaacgcggccatcaggtgacgttatgcgatctgtctggcgaaatgatcgcccgcgcgcggcaggcggccgaggcaaaaggtgtgagcaaagacatgcattttatacaatgcccggctcaggacgtcgcttcgcatttggaaagcccggttgatctgatattgtttcatgctgtgctggagtgggtagccgatcctgtcggcgtattagaaacgctctggtcagtattgcgccctggcggcgcgctgtcgttgatgttctataacgctaacggtttgctgatgcacaatatggtggcgggtaattttgactacgtgcaggcggggatgcctaaacgcaagaagcgcacgctgtcgcctgactacccgcgcgaccccgcgcaggtgtaccagtggctggaggcgattggctggcagattaccggtaaaaccggcgtgcgtgtgtttcatgattatctgcgtgaaaaacaccagcagcgtgactgttatgagaccctggtcgaactggaaacgcgttattgccgccaggagccgtatattagccttgggcgctacattcatgtcaccgcgattaaaagcccggcgctagccgcagatgcaaggataacctatgagtgaattttcccagacagtccccgaactggttgcctgggccagaaaaaacgacttttccatctcgctgccggtagacagactttcctttctgctggcggtcgccacgttgaacggcgaacgccttgacggcgagatgagtgaaggcgagctggtggatgcattccgccatgtgagtgatgcgtttgagcaaaccagcgaaaccatcggcgtgcgcgctaataacgcgattaacgatatggtgcgtcaacgtctgctgaaccgctttaccagcgagcaggctgaaggcaatgcgatttaccgattaaccccgctcgggattggcatcaccgattactacattcgtcaacgcgaattctctacgctgcgtctttctatgcagttgtcgattgtggccggcgaattgaagcgcgcggcggatgcggcagcggaggggggcgatgagttccactggcatcgcaatgtttacgcgccattgaaatattcggtggcggagattttcgacagtatcgatctcacccagcgcatcatggatgaacagcagcagcaggtgaaagacgatatcgcacaactgctgaataaagactggcgggcggcgatttccagctgtgaactgctgctttccgaaacgtccggtacgctgcgcgagttgcaggatacgctggaggcggcgggcgataagctgcaggctaacctgctgcgcattcaggatgccacgatgacgcacgacgatctgcattttgtcgacaggctggtgtttgacttacaaagtaaactcgaccgcattatcagttggggtcagcagtctattgatttatggatcggctacgatcgtcacgtgcataaatttatccgtaccgcgatcgatatggataaaaaccgtgtcttcgcccagcggttgcgccagtccgtgcagacttattttgacgatccctgggcgctaacctatgcgaatgccgatcgtctgctggatatgcgcgatgaagagatggcgttgcgtgacgatgaagtcaccggggagttgccgccggatctggaatatgaagagtttaacgagatccgcgagcagttagcggccatcattgaagaacagctggctatctacaaaaccagacaaacgccactggatcttgggctggtggtgcgcgagtatctggcgcaatacccgcgcgcgcgtcatttcgacgtggcgcgtattgttatcgatcaagcggtacgtcttggcgtagcgcaagcagatttcaccggactgccagccaaatggcagccgattaatgattacggagccaaggtacaggcgcatgtcattgacaaatattgaacaagtgatgccggttaagctggcgcaggcgctggcgaatccgttatttccggcgctggatagcgcattacgttcgggccgccacatcgggctggacgaactggataatcatgcctttctgatggattttcaggaatacctggaagagttttacgcgcgttataacgtggagttgattcgcgcgccggaggggttcttctacctgcgtccgcgttctaccacgcttattccgcgctcggtgttatccgaactggatatgatggtcggtaaaattctctgctacctctatcttagcccggagcgtctggccaacgaagggatctttactcagcaggagttgtacgacgagctgcttacccttgcggacgaagccaaactgctaaagctggtgaataaccgctcgacgggatctgacgttgatcgtcagaaactgcaggaaaaggtgcgttcttctttaaaccgcctgcgtcgtttgggcatggtatggtttatgggccacgacagcagcaaattccgcattaccgaatcggtcttccgctttggcgcggatgtccgtgccggcgacgatcctcgcgaggcgcagcgtcgtctcatccgcgacggggaagcgatgcccattgaaaaccatctgcaacttaatgatgagaccgaagagagtcagccggacagtggagaggaagaataatgattgaacgcggtaaatttcgctcgctaacgctgattaactggaacggtttttttgcccgcacttttgacctggatgaactggtcacgacgttatccgggggcaacggcgccgggaaatccacgacgatggcggcgttcgtcacggcgctgatcccggatctcacattactgcactttcgtaacaccacggaagccggcgccaccagcggttcgcgcgataaaggtctgcacggtaagctgaaggcgggtgtctgttactccatgctcgacaccattaattcccgccatcagcgggtggtggtcggcgtgcgtctgcagcaggtcgctgggcgcgatcgcaaagtggacatcaaaccgttcgctattcaggggctgccgatgtcggtacagccgacacaactggtgacggagacattaaacgaacgtcaggcgcgcgtactgtcgcttgctgagctgaaagacaagcttgacgagatggaaggcgtgcagtttaagcagtttaactccatcaccgattatcattcgctgatgtttgacttagggattatcgcccgtcgtctgcgctccgcttccgatcgtagtaaattctatcgcttgatagaggcctcgctgtacggcgggatctccagcgccattacccggtcgctacgcgattatttattgccggaaaacagcggcgtgcgcaaggcgttccaggatatggaagcggcgctgcgcgagaaccgactcacgctggaagcgattcgtgttacccaatccgatcgcgatttgtttaagcatttgatcagcgaagccaccgattatgtggcggcggattatatgcgccacgccaatgagcgtcgggttcaccttgatcaggcgttggcgtttcgacgcgatctgtacacatcgcgcaaacagctggcggcggagcagtacaagcacgtcgatatggcccgtgagttgggcgaacataacggcgccgaaggttctcttgaggcggattaccaggcggcgagcgatcacctgaatctggtacaaaccgcgctgcgccagcaggaaaaaattgaacgctacgaagcggatcttgaagagctgcagattcgactcgaagagcaaaacgaagtggtggcggaagccgccgaaatgcaggacgaaaatgaagcgcgtgccgaagccgccgagctggaagtcgatgaactcaaaagccagcttgcggattaccagcaggcgctggatgtacagcaaacgcgcgcgattcagtataaccaggcgatatcagcgctcgcccgcgctaaagaactttgccatctgccggatctaacgccggaaagcgccgccgaatggctggatactttccaggcaaaagagcaggaagctacggaaaaactgctgtcgttggaacaaaaaatgagcgtggcgcaaaccgcgcacagtcagtttgagcaggcttatcagctggtagcggcgatcaacggcccgctggcgcgtagcgaagcctgggacgtggcgcgcgagctgttacgggacggcgtgaaccagcgtcatctggcggaacaggtacagccgttgcggatgcgcctgagcgaactggaacagcgactgcgcgagcagcaagaggcggaacgtctgctggcggagttctgtaagcgacagggcaaaaattttgatattgacgaactggaagcgttgcatcaggagctggaagcccgcatcgcgtccttgtctgagagcgtgtcgtcagccagcgaacagcgtatggccttgcgtcaggaacaggaacagctgcaatcccgtatccagcatctgatgcaacgcgctcctgtctggctggcggcgcagaatagcctgaaccagcttagcgaacagtgcggcgaggagtttacgtccagccaggaagtgaccgaatacctgcaacagctactggagcgtgagcgcgaagccattgtcgaacgcgacgaagtgggcgcgcgtaaaaatgcggttgatgaagagatcgaacgtttaagccagccgggcggcgcggaagaccagcgtttgaatgcgctggcggagcgttttggcggggtactgctgtcggaaatctacgatgatgtcagccttgaagatgcgccgtacttttccgcactgtatggtccgtcgcgccatgcgatcgtcgtaccggatttatcgcaaatagccgaacagcttgaaggtctgaccgactgcccggaagatctgtacctgatcgaaggcgatccgcagtcttttgatgacagcgtattcagcgttgacgagctggaaaaggcggtggtcgtgaaaattgccgaccgtcagtggcgttattcgcgttttccgtcgctgcctatttttggccgtgcggcgcgcgagaaccgtattgaaagtctccatgcggaacgggaagtgctttccgagcgctttgccacgctctcgtttgacgtgcagaaaacccagcgtttgcaccaggcgttcagccgttttatcggtagccacctttctgttgcctttgaggacgatccggaagcggaaattcgccgactgaacgggcgtcgcgtcgagctggagcgcgcgctggcgacgcatgaaagcgacaaccagcagcagcgccttcagtttgagcaggccaaagagggcgtttccgcgcttaaccgtttgctgccgcggctgaatttattggccgatgaaacgctggccgatcgggtcgatgaaattcaggagcggttggatgaggcgcaggaagcggcgcgatttgtgcagcaatatggaaaccagttagccaaactggagccagtagtttccgttctgcaaagcgatccggaacagtttgagcaattaaaagaagactatgcatggtcgcagcaaatgcagcgcgacgcgcgccagcaggcttttgctctggctgaagttgtcgaacgtcgggcgcatttcagctattccgactcggcggaaatgctgagcggcaacagcgatctcaacgaaaagctgcgccagcggctggagcaggcggaagccgagcgtacccgcgcccgcgaagcgctgcgcagccatgccgcgcagttaagtcagtacagccaggttctggcctcgctaaaaagctcttacgacacgaaaaaagagctgcttaacgatttgcagcgcgaattacaggatattggcgttcgcgccgacagcggggcggaagagcgcgcccgccagcgtcgcgatgaactgcacgcccagttgagcaataaccgttcgcgtcgcaatcagcttgagaaagcgctcaccttctgcgaagcggagatggagaacctgacccgtaagctgcgcaagctggagcgcgattatcatgaaatgcgcgagcaggttgtgaccgcgaaagccggctggtgcgcagtcatgcggatggtgaaagacaatggcgtggaacgccgtctgcaccgtcgtgagctggcttatctgtcggcggatgaactgcgctccatgtcggataaggcgttgggcgcgctgcgcctggccgtcgcggataacgaacatctgcgcgacgtattgcgtctgtcggaagatccgaaacgcccggaacgtaaaatccagttctttgtggccgtttaccagcatctgcgcgaacgtattcgtcaggatattattcgtaccgacgatccggttgaagccattgaacaaatggagattgaactgagccgtctgacggaagagctgacatcgcgtgagcaaaagctggcgatcagttcccgcagcgtggcaaacatcatccgcaagactatccagcgtgaacagaaccgtatccgtatgctgaaccaggggttgcaaagcgtctcttttggccaggtgaatagcgtgcggttaaacgtcaacgtgcgtgaaacgcatgccaccttgctggatgtgctttcagaacagcaggagcagcaccaggatctgtttaacagcaatcgtctgaccttctccgaagcgctggcgaaactgtaccagcgtctgaatccgcagatcgatatggggcaacgcacgccgcagaccatcggcgaggagctgctggactaccgtaactatctggaaatggaagttgaagttaaccgtgggtccgacggctggctgcgtgcggaatccggcgcgctatcaacgggggaagctatcgggaccgggatgtcaattctggtgatggtggtgcaaagctgggaagacgaagcgcgcagactgcgcgggaaagatatttcgccatgtcgcctgctgttcctcgatgaagcggcgcgtctggatgcgcgctctatcgccacgctgtttgaactatgcgaacgtttgcagatgcagctcatcatcgctgcgccggaaaacatcagtccggagaagggcacgacgtataaactggtgcgtaaagtgtttcagaatactgagcatgttcatgttgtcgggctgcgtggctttgcgccgcagcttccggaaacgcttcccggtacgcagacggaagatacgccttcagaagcgagttaaatacggcagaaacgatgacgtgcctgatggcgcctcgtttatcaggcaaggccggataagtcggttacgccgccatccggcacaacaagttctgttttatcattagcctggggcggcgaaagccgcctttttctttatctgaaaaatctctccgggtagtgcattttctttaaacttctttacattaggttaggcaaaaacgtaacgaactttatatactggagttaagcctgacgagtgagcaggctgactcgtcatactaaacaaaagcattggttgcggttgacccgcgctgcgggcagcgcagtcatgcggagtatgataacgaaaacagggggcaagggatgttgcttaataagatgtgtggtcgttgtctgtcggcaatcagtttatgcctggccgtaacattcgctccactgttcaatgcgcaggccgatgagcctgaaatgatacctggcgatagcgccgttgccgcgacggatctggctgggccgcagaagcaatcagccgcgacggcgattatggccgggattcagccgctgccggagggcgtttcagccgagaaagtccgggctgatttacagtcgcagcttccttccggctatacgccggtctatatgagccagctgacattgctgtatgccgcgcgcgacatgaagcccatgtgggataatcgcgatgcggtgaaagccttccagcaacagttggcggaggtggcgattgccggattccagccgcagtttaccgcctgggtggcattgttgaccgatcccgccgtaaacggtatggcgcgcgatgttgtgttgtcagacgccatgatgggctatctccatttcattgcgaatatccccgtcaaaggccagcgctggttatatagcaacaaaccttacgcattggcgacgccgccagtctcggtgattaaccagtggcaaatcgcgctggaagagggccagttgccgatgtttgtcgccagcctggcgccgcagcacccacagtatgcgcccatgcatgatgcgctgctgaagctggtggcggactctcgcccgtggccgcagttgaccaataccgcgacgctgcgcccggggcaatggagtaacgatgtgcctgcgctgcgcgaaatattacagcgtacggggatgctggatggcggtccaaagatagccttacccggcgataacactgctgatagcgccgtcgtcagcccctccgccgtggtcgacgaaacatcggtggcgcacgacgaaccaacggcccgccgtagtaagccggctccggcggcacgcgcctacgatcgtgaactggtcgaggcggtaaagcgttttcaggcatggcaagggctgggggcggatggcgttattggcccggcgacgcgtaactggcttaatatgacccccgcgcaacgcgcaggcgtactggcactgaatatccaacgtttacgcctgctgccagcggaactctctaccggtattatggtaaacattcccgcttattcgctggtctactatcagaatggcaaccaggtgctggcttcaagggtgatcgtcgggcgtcccgatcgtaaaacgccgatgatgagcagcgcgctgaataatgtggtggtgaacccgccgtggaacgttccgcccacgcttgcgcgtaaagacattttaccgaaggtgtggaatgacccaggctatctggagcgccatggctacaccgtgatgcgcggctggaacagcaaagaagcgatcgatccgtggcaggttgactgggccaccattacgccatcgaatcttccgttccgtttccagcaggcgccaggcgcgcacaattcgctggggcgttataaatttaatatgccgagttcagatgcgatctatctgcacgatacgcctaaccatactctctttcagcgtgacgccagggcgttaagttccggctgcgtgcgggtcaataaggcctctgagctggcgaatatgctcttgcaggatgctggctggaacgatgcgcggatctcaggcgccctgaagcaaggcgacacgcggtatgtcaatatccggcagaacattccagtaaatctttactatctgaccgcatttgtcggcgcagatggacgtatgcaatatcgtacagatatttacaattacgatctcacagcgcgatccagcgcacaaattgtgccaaaggttgaacaattaatcaggtaaatgaagaagttctggtaaatatgttgtcctaatgtttggcttcaacggggcgtttcgctgtagacccccgttgtggctgggggagggccatcttgacgcgggctttatcggcagttaaggtgcctttcgtgcgccagaagtgcatatacaacaacctttaagtcgaccgggccgttcagaagtctgtgccagccggtatcatgtctgcttaaaggtagaagtgtattaacgataacattgacctgtagacctgattatcatggacaaatttgacgctaatcgccgcaagctgctggcgcttggtggtgtcgctctcggcgccgccatcctgcccgcgccagcgtttgccacactctcgaccccacgcccgcgcattttgacgttaaacaatctccataccggagagtcaatcaaggcggagtttttcgatggaagagcctacattcaggatgaattagcaaagttaaaccattttttccgtgactatcgcgcgaataaagtccgatcaatcgatccccgcctgtttgaccaactttaccgacttcaggggctgttagggacgcgtaaacctgtgcagctcatctcaggctaccgttctcttgataccaataatgaattacgcgcccgtagcagcggcgtagcgaaaaaaagctaccatacaaaagggcaggcgatggattttcatattgaaggcgtggcgctgagcaatattcgcaaagcggcgttatctatgcgcgcaggtggtgtaggatattacccacgtagtaactttgtgcatattgataccgggccggcgcggcactggtaatcagcgaggcttaatcaaaggagcagtatgaactatcgtattattccggtcaccgcgttctcccagaactgttcattaatctggtgcgaacaaacccggctggcggcgctggtcgatccgggcggcgacgcggaaaaaattaaacaggaagtggacgccagcggcgtgacgttgatgcaaattttactcacgcatgggcatctcgatcatgtcggcgcggcgagtgaactggcgcagcattacggcgttcctgttatcggtccggaaaaagaagatgagttctggctgcaaggactgccggcgcaaagtcgcatgtttggtctggatgagtgtcagccgctgacgcctgatcgctggctgaacgacggcgatcgcgtcagcgtagggaatgtgacgttacaggtgttacattgtccgggacacacgccgggacacgtggttttctttgatgaacagtcgcaactgctgatctccggcgatgtgattttcaaaggtggcgtcgggcgcagcgattttcctcgcggcgatcacacccagttgattgacgccattaagcgtaaattattgccgcttggcgatgatgtgacctttattcctggccacggcccgctctctacgctcgggtacgagcgtctgcataatcccttcttgcaagatgagatgccggtctggtaagcagaatgaaaaagcctgcacattgcaggcttttttatcggtcacgccagtcggcagctttttacagtaccgcgacaatggcttcgcacagcggcgccatattatccggggtcatgcccgccacgttcacgcgaccagaagccacggcataaacgccgaactcttcacgcagacgcagcacctgatctttggtcagaccgctgaatgagaacatcccgttctgcttgataataaagctgaagtcacggttcgcgcctttttcctgcaaggtattcacgaacagttgacgcatacgctgaatacgctggcgcatgtccgtcagttcctgttcccagatagcgcgcagggcgtcattactcaggatagtcgcgacgatggacgcgccgtgcgctggcgggttggagtagttagcgcgaatggcggatttcatctggctaaaagcgcgatccacggtttccgcatcggcggcaacgagggtgcaggcgccgacgcgctcattatataagccgaagtttttggagtaggagctggcgacaataagctctttatgcagcgcggcaaaggcgcgcagaccttccgcatcttcttccaggccgcgggcaaagccctggtaagcgaaatcgaatagcggcagccaccctttttcaacggaaagctcagccagaacctgccactgttccagagtagggtcaatgccggttgggttatgacagcaaccgtggaacagaaccacatcgccggcctgtgcttcgctcaggctggcttgtagcgcttcaaaatccagcgtgtgattttccgcatcgtagtaagcgtactcccgaacttccaggccggcagcgttaaacacgcttttgtggttcggccagctggggttgctcacccacacccgttttaccggagtattttttgccaaaaagtcggcggcaatgcgtaacgcgccggtaccgcccggcgtttgcgccgtgcgtgcgcgcttatcgttaatcagcgcgctgcctttgccgaacagcagttcctgagtgcagcgagcaaattccggaatcccgtcaatgccgagatagtttttcgtcgtttcattttccagtaaatactgctcggcttttttaacgctggtgagcaccggtgttttgccggtttcatctttatatacgccaatgccaaggttaattttccctggacggtcatcggcgcgaaacagatcggccaggcccaaaatcgggtcggcaggagcggcggttatgttctcaaacatgacgaggttccattatagttacagaagggaaatccgctatcaggttaacggcagatttacaaaatgccaaccgttagcgctaaaaagcccgcctgtttttgaaagacgcacattttctctaagagagataaaaaaacaggaccgaagtcctgtttttgaggcataaaacaaaggggtctgctgatcagaactggtaagtaataccgacagccgcctgatcgtcggtgccaacgtagctggagctgtagtcgttttcgtccagcaggttgaaacggtagtcaacccatacgttcatgtttttgttgaagtagtaagtcgcgcccgcctgaatatatttcgccagatcggccgagccgccggcgccgttcaactgcttacctttactctgcacatacgagattgccggacgcaggccgaagtcaaactggtactgagcgaccacttccaggttctgcgttttgtttgccatttccacggtatcggtaaccgtattttcaacaatgctcatattgcgggtttcagcatatacggcagccaggtagacgttgtttgcatcatatttcgcgccaacggcccacgattctgcgcgatcgccattaccatcgcgatcctgctgatcgttagtacgcttgctgttgctgtacgctgcggtgacgccaaagccgtcgaactcatatgccatggtgtaacctacgccatcgccattctgagagttaatgctgtggttgtcctgatttttaccctgatactggataccgaaagagagaccgtccaccagaccaaagaagtcagagttacggtaggtcaacaaaccgccagcacggctggtcatgtagttatcagtataggcgccgccccaggtttcgccggagaagtagggggccatatcggtataggattcaacatcataaacgataccgtagttacgaccataatcgattgaacccacttccgcgtatttcaaacccgcgaaagccagacggaccagattcgagttctgctgttcgccttcagcgcggtctgctttagtacggtattcccactgaccgaaaccggtcagatcggtgttaatctgcgtttcccctttaaaaccaatctgggcataagtctggtcggcatttttactatcgccggtcgttgtccatacgtgacgacccacggctttaccgtacagatccagcttattaccatctttattataaatttctgctgcgtttgcggttgcagcagccagcagggcagggatcaccgctgccaggattttgcgcttcatcattatttattaccctcattggtttttttatatgacacctgccactgccgtcaataaattccgtcaataaaactttacagaaatattgatgagagtttggtgtctttatgtgtctgacaggcatctttccattcaaactaacgtttcgctaccgtgaaagtgctacaaagataaagatttggtttcaaaaggaaataatatgtaaacaaatgttatttttacggaactttgtgaacaacgtcaaacttcccctgagttatcgttttgatttgatcgtttttcttttatatccatgattttattgaatttatttgttcgcgacaccgttgtgcctgaaaaagcagctgacgagctatttcataaaaatagccatttagaagtctggatgtctgaaattgtggtgaaaaattgtgctattagagcagaaaaatctaatccgcaataaaattaaggattaatttttatgtgtaaatattttcgtgaaatatacagtaacaagatgtggtaattcagagggttgtaattaattttatttacttattgataataaaactgacattcaggcgaaaaaaaaggccagcatagctggccttgagtgtgacgtaaaaatcagaagctggcgttgcgtggggtccgtgggaacggaataacatcgcgcacgttttgcacaccagtgacgtaagcgataaggcgttcaaagcccaggccaaagccggaatgcggtacagtaccgtagcgacgcaagtcgcgataccaccagtaatcctctttattcagccccatttcggccatacgggcatccagcacatccagacgctcttcacgctgggaaccaccgatgatttcgccgattcccggcgccagcacatccatggccgccacggttttgccatcttcgttaaggcgcatgtaaaacgctttaatttctttcggatagtttttcaccactaccggcgctttgaaatgctcttccgccagataacgttcgtgttcggaagagaggtcgacgccccagaacaccgggttttcaaatgtcttaccacagcgttccagaatggcgaccgcatcggtgtaatccacctgagcgaagtcggtagagacaaaacgctccagacgagcgatagcgtctttatccacgcgttcggcaaagaacttcatgtcatccgcacgctcttccagaaccgcgttgaagacatatttcagcatggcttccgccagacgggcgttgtcttccagatcggcgaatgccacttccggctccagcatccagaactccgccaggtggcggctggtgttggaattttccgcgcggaaggtcggcccaaaagtatagattttggacagcgcgcaggcataggtttcaccgttgagctggccggagacggtcaggaatgattctttgccaaaaaagtctttgtcaaaatctactctgccctggtcgttacgcggcaggttttccagatccaacgttgagacgcggaacatttcgccagcgccttcggtatcggaagcggtaatcagcggggtagagacccaaaagaaaccctgctcatcgaagaagcgatgcagcgcctgcgccagagtatggcggacgcgcgctaccgcgccaatcaggttggtgcgcgggcgcagatgcgcgacttcacgcagatactcaatgctatggcgttttgccgccatcgggtaggtatccggatcttccacccagcctgcgacttctactttcgtggcctggatttcgaaactttgcccctgtcccggcgacgcgacaaccttacctgttactaccacggagcagcctgtcgtcaggtgtaatacttcttcattataattgggcagagaattattaatgacagcctgtacaggatcaaagcaggagccgtcataaacggcgaggaaggagatgccagcttttgaatctcggcgggtacgcacccatccgcgcacggtgacttcttggtcaacggctacgcggccctggagtacgtcggctacaggcacaacgctcataatattctctctagttaatagtcggaaaaaataaacacttgtccacccgaaatgggggtattcctatgttacctggcatctgcaatcagacaagcagaaatcgcatctggaagcaggttttcagaaagaaacctgtaaaaagttcgcacctgctcgcgaaccattgagaatttaggctggttttgcaagctttgcgcacgttactcgatcaggacgcgcatctcttgcttggcgttttgcatcacgacaatcgttttaaaagactttatattgcctgaggaaaagaaaagctcacgggtaagcgcttcatattccgccatgtcacgaacattgagcaccagtaaaaagtcgaaatcgcccgttacgtagtagacctgctgcacctgcgggcaactgacaaaccgttgacgagcctcttccagtaaattgaatcgctcgttttcgatcaccacctgcaccacaatcgtgaccgggcgtcccactttgccagcatcaataaggctgacattgcctttaattatgcccgcctcctccagtgccgcgatacgacgattcactgccgaaggtgaaagattgacctgttcggcgatttcccgctgagaaagacgattatcgcgctgcaataatgtcagaatgtttttatcccaggcgtcaagcttcatatcgcaaataacctctttaatgtgatgactatcactgtgcgcaattttgccgcgtccaggccgttaaaaaaaggtgaaaattgcacgacgatgggcattttcgcgccatttaacagcaataagcatagtactatcataatcagcggaataaagaaaaggacgtaatagatattgtgcgactcttttatcagtacgtttattaaagtgaggataaccactactacagccacaaaacgcgagttctttgcttgtttctactcaataattgacaaaaatatattatttcaataaataaactttaacaaaaggtatcattatgcatgagcttattaaatatcagtttaatacacgtcggaaaaaatatggtacaggagcggccttaagtttgcttaacggaaatgttgggcatgaggtgttagcatttcataaaaaattacccaattatgccgtcacgccgttacataatctggcgcatctaagccagcggcttggactagggtccatccatattaaagatgagtcctggcgttttggcctgaatgcttttaaaggtctgggcggctcttatgctgtaggaaaatatctcgctgataaattgcaatgtgatattaactcgttaagttttgctgcccttaatactcctgagattaaagaaaaaattaaagattgtgtttttgttaccgcgacggatggcaatcatggccgtggtgtggcgtgggcggcagagcaattaggtctaaaagccgtcgtttatatgcctaaaggatcatcgttaatccgggcagagaatattcgccatcatggagctgaatgcaccatcaccgatctgaactacgatgatgcagtgcgactggcccatagaatggcgcaaacaaaaggctgggtgcttttgcaggatacagcctggacagggtatgaagagatcccaacatggattatgcaaggctatatgacactagcggttgaagcttatgagcagctcgcagaaacaaacagtccgttgccaacccatcttattttacaagcgggggtgggatcgtttgctggcagtgttatgggttattttgttgaaaaaatgcaggaaaatatccctaatattattgtggttgagccgcatcaggccaactgtctttatcaatccgcagttatggatgatggtcaacctcactgcgtcactggcgatatggcgacgataatggccgggcttgcgtgtggggagccgaatattatcagttggcctattattcgggacaacaccagttgttttatttccgctgatgactgtctggcggctaagggtatgcgtatttctgccgcgccgcgtccaggtacggatacgccttttatttccggcgagtccggagctattggcgtagggttactttatgagttgatgaacaatatgcattatcaggatcttgctaatcgcttacagcttgatgccagtgctcatgttctgcttattagcaccgaaggtgatacgtccccagatatttatgaagatatagtctggaacggacgcagtgcttaaacattacgactaaaaaattagataataaaggtagcatgtaaaaatgcgttttttatacgcataataaacctaatgcaggaagcaagactttataacaatataccattaaaacggcatttagtgagtaagggatgctcctacccgctgactttccagtttagtgttgttggcaaaattcaggattacgctgaactggaaagattatttctgagactgaacgaattaatttaaatccgaggtcattatgttagagcaactttcacaactctttgaatttctatggggtggcccattatttttgtgtgtcatcggcattggtttttattttacagtacgcctcaattttttccagattattaatttaaaagacatttaccgtaatacaattggtacacttgccggaaaaaataaacaaaacactactggcgaggtagcgtctaaaaaatccttaaaatcaatagaggtggctgccactgtgctatccggctcattaggcgcgggaacgatcgcaggtgttgctgcggctattgcggttggcgggcctggagcaattttctggatgtggatcattgcggtcgtgggtatgatgaccaaaatggttgaagtgacgctggcggtgaaataccgaagtaaaggtgagaatggcgaatattatggcggcccaatgcattatattaagaaagggctcaataaaaaatggcatcccctggcaggattatatgcgtttgcattaatgattctggttattacggatgcctgttttgtgcaaactaatacgatggcggcggtcattcactatacgtttgacatcccaacaagcgtcatcggaggatttattgtcatcgtaggcgcgttggttattttaaaaggactctccagtcttggtaaattctgtacgattgcacttccaccgatcaccattgcctatttcattggtgccgctggtgtagtggtattgaatatcgaggctatcccacaggttataaaaagtattttctattatgcctttgcccctgcgccagcagccggtggctttgtcgggtcaaccatcatgatggccatcagtaaaggagccagtcgcggaatattcactaacgaagccggcatgggtacctcggccacagtacatgctactgccaacgtggattatgctttccgtcagggaatgtggggggcagtggaagtattttttgtctcaatgattacctgtaactttaccgcatttgctgtacttgcttctggtatgtggacagacgccagttatcaaggtattcagattatctttgccgccttaaaagaaacatggcatccgattattgttcaggttctctgtctcggtgtggcgttgattctgtttacttcttatcttggttcatatattaaatttcgcacttcgataaactatatctttggcgataagctagaacgcatcattaaatggctatattttttgccgccactgattgccgttaatatggaaatcccggtaatctggttaatggctgatattgctgtcggttttctggttatccccaacgtaattgctctgttcttgctgcgtaaagaatttattagcgaattcaatttattcagaacgcgtacacagcgggacactaattctgaaaaaacaacgcaaattacgcacgtaaatatgtcgaagagtgaagggaaagaggagtaaccatcgcggccagaacaggtaagatggtcagaagagtaacaaagcgcccactttccgggcgcttcgcacaggcatggttaacttgctttacgcacctgcgggagatcgaacgctttacgcagcgcgcgcacaaacgctttatcatgacagatcgttttaccggggctgtcggaaagtttagccaccggctttccgttacattccacgagcttaatcacgatattgagcggttttacctgagggatatcgcaggtcaggcgggtaccgatgccgaagcttaactgcacgcgagaggcgaaatggcgatagagctcgaccgcctttggcagatcaaggttatctgaaaagaccagcgtttttgtcagcggatcaatccccagcttttcataatgggcaatcgccttttcgccccatgcgacagggtctcctgagtcgtggcgtaacccctgataacggctggcgaattcaatgccgaaatcgcgtaaaaacgcatccattgtaatgcaatctgtcaaggcgataccaagctggtccggatattcgttaagccaggcggccaacgcggcacgctggctggtcgccaggtccggactgatttgttgatgcgcctggaaccattcgtgcgcctgagtgcccatcggcgtcagcgccaggcgacgcgcgagatcatagttgctggtgccgacgaaccatgactcctgctggagacgtttaactatcgcctgctgcacttcacgagagaaacggcggcgggtgccgaagtccatcaggtggaagcgggacatatcgagattggcggttaacgcagtgaaatcaaccagcttactttccagcgcgtcgagcgcctgatcaacacccgcgtttggcgagcggtagtgatgaaccagctcactgatcacggccagcagcggcacttcccacataatgacttcacgccacgggccggttaagcgaatattcagcttgccgttatcgttggtgacacagacttgagctgggttatagcgaaactcgcgtaaccagttcagataatccggtttaaaaaagggcaggccggagagccactggaactcgtcctccaggaggcgcaggtgctgcatcgcgtccacctgctcgcgaatagcatcggcataaatacccagcaggtcgtcgccacggcaacgaaactcagccgctacctgcacatcatagtagtggtgaaaaacggcttgctgcatatgcaacttataagcatctgtatccagcaacgagtgcagaacaggagaagcgaattgtgtcataggtgcgctgttgcgtcctctcacgggagcgtttagtacaataaacaactaagaaaaccgctggagtataccttgtttagcgatttattgaaccccgatcacaccataagctgtctttagggtcgagcgcatttcgtgccccatgttataaaaatgtagcgatgcgactgctaaccccttgaatttaaggatttctactgcgctgctaccatgctttggggcagtgatggggcatagcggaaaagtgcctggttgagcagagaaacctgttctgcgctcttctctgacatccactttccatacaccttgtaaaccatctgtgcatcggtatgccccatctgcgttgctataaagtttgggttagcaccagctgataatgaccagcatgcataggtatgtcgtgactgatacgcgttacggtaacgaatgccggcacgcttgattatcggggcccaaattttattaatggaattaaccgcgtagtgatatcctgtgcgaggtccacgtttgacgcattgagggctgaatacgaacgtgcagggctgaatgacagattgtccatattcccgcaacttcacttcaacctcaaactgccggccaaggcgtgtcaactgggcctgattcctcagggcatcaatagctggttgaatgagatatatcaccctgtcagtacctgcgtcggtttttggcagggtgaactcatccgtctgggtaaggttgcgcttcacaatgatcgtcccggcatgcagatcgatatcttcccaggccagaccgcacaactccccatgcctcattccggtatagactgccagtgaccagagatttctcatctgctggtgtccgcatgcctggataaacctgatgaactcgtctgtcgtgagtggatctggttcccctttcgctttcttgagacggttaattccgctaaacgggttttcctttgcatagccgttatctgttccaaactggaagatctcggccatcagcatcatgtaattattcactgtggacgatttccggcctttaacctgagtccggtgatccttcttcattacctgaaagcccgtcagcaactccttcctgacatacagcaaatcctcagtagtcaccgcagaaaccattttgttttcgccgatgagtggaagcatgttttttatgatagattcgtacctactcatggtattagagctgatctccattctcttcagctcggaccatctttcggtaagctccagcacagtaatttcctttctatcctgaccgaaccgggcaaggttcggtgagtttgggaatttttccacatagttaaaattccccatccttatcgcaaaacaaaccgaagaacgcagttcgccagctatcttgcgattttttgcagtgtcagggataccaaggttttccctgacacgtttacctttatacagaaaccagatgcggagcgaaccgccgtggttttcgacgcctgtcgggtatgatgcattagccattaatccctcctgacgtccaggagcattgacgagtgtacagcttttcatgttgtcttcgcacctggttgattttttttctgcgcctcgatccactgatcaacggcttctctgttgtatatgcattcgctcgaaggcttcggatttccgtctggtgaaatgtgcaggtactcgcggcccagcatccaggattcttttctggcgcgggtaatggttccgggcttaagcccggtaaccgcaatcagaactttttcgctaacccacttgtttggcgtcagttggataatgttgctcatcgttttctccagtggccccgcagcgggccatcgctaatattcagtttgcctgtgctggcagatttctaagtttccggacgccgatcattgcggtggctacgtagctggtggcccggttaactacttcaacaggcacctttacgccatccactacaacggtgtaattggtaacgtgcttttgtctgccgtaatcgccgaacttttcatgatgcgccgccagtgcaacatcacatgcgcgacggcccaatggcgattgcttactgcgatttataaggcgcataaaacctcctcaggcgggagggcgtaacccctcccgatgcaattagccgatgtattccggtttcatatcgtccagggtgacgcggtacttatcgtgcagttcgtcgccaagatggcgtttagcagcgccaagcgtgctttcagctttagcaaacatctctgcggcttccggttcgccagggtttggaattgagttgatcactgcctcgactttgttctgtgcatcgacctggtaatagcgcttcactgctttgttttttaattcggtgaacagcgcagtacccagcaacgctttctgtgattcgatatccgcacggattgcttttgcctgatcaacggaacttgctgtatcaatgcgttcgcgaagatcgtcggcaacagcatcaacgttagctgccgactcctgcgcgctggtcctggtgctaacctcgctggtgatttcctgtacgctcatgcgctggactggagcagggttaatctcgcgttcttctcgttgctcaacctcatcagggctgtacacgccgaggatcacttccgggcagtacaggcgagcccaatatttaacgcccagataggcaatttgctgtttagggtttgaaacccatagcggagaattgcgggtaacaacgccggagaggtaaagaggttctccccaggtgatttcagattcacctcgcagaatggcaccaacctgaacgaacaggccgatctcgtcctcatctgtccagccacgaacgcgctcagtgacggtgtacttcccatttttaccgtttttatcgcgtgtgatttcctgtgtcctggtgcagcgctcccagtcacccccatagcggtaatgaaaacggccatgaatggcactggagcttgcgattactgcgttgaccagttgtgcctcgtaaccaagaacaccgttaaccaggtgtgttttctgagccacagcgtaagggttcatgccccattgcatagcctgcatgacgatagccatacagtcggctggtttccctgcaaggtgtgccggtaccgtcacctgtgagtctgccatcaggttagcgaaagctgttaactgacccagtgcctgaacgttaaaaattgcgttactggcagaaatggtgtttggtgcctgctgctcagtggtaacaatatttgtgttttccatgattttccccttatgcctgtacgcgcaacgcttcaaggcggcgcacatcaaaatcgttcagttcgtcggtgtagtcttctgtgataggcgctgaccattcaccagtgtcgaagccgtttgctatctctcgcattgttttgcggtattccagcatgccaagttccagcaactcggtagacgcctcaatgatggcgacccagtggtagttctcgtctttgttgacgaaaatccagaaaaactggtccagcgccgcagtttcgcagtacatggccgcgctcaggtgatagtcccgatcgatgatttcccggtgcaacttcgcacgcaggccttcctgcttgatgttccacatgctgatagttttcaggtcggcgccaatgcgcaggccgcccatatcgagctcaaggtcagggcgtacccgaacttccaacccggtttcctcatcaatcccaaaatagctaacctcgacagcgcggcttgggtgagtcagcaatttgccggcggtcgggtgctccagcagggctttctgaatgttcagcgcggtgctgagctgttggcgggtgaccagcactttcccttcggtgttctcccgccacgcatccagcaattcgtcggcgaataccactgccgggttgactgatttcacggcctgaatcagatcggccttcgtgccagagactttcaacggcgacgatttttgcgcttcctgagcgaccaggtcagggttgattattgccagttgctccagcagcgcgtcacggctgccgctggttttaaccggcgcgggcagggtgacgttgtactctttgatgcaggctttcatcgccgtggctgtatgtttggtgccgttttcaatgcgctggaattcttcgggaagctgctcatacgatgcataggtttcatctaccgaagctccaagcggcatctgcgacggcagggtggcgttgtactcttccagcagcgctttgatatcgtcagcactcagcagcgctggcaggctggcgttgtgcgcgtcgatgaactcgcgcagggtggcggtggtggtgaaagcaccctcagggatctccggctctacgctgaactccgcttcgaggttttccggctgtagagccagaacatgtaccaggttgcccatatcaagcactggagagcgctctttgacgatagttttctctacgtgacgcgcgttaaagtacatcagcgacacgcgagcatctttcacctgagttgagctgatcccattggcggcgtggtaaacttcgtttggtacaccttcatagcggcccggctcgaagtattccggccaggctgcttctggctcttcttgttgcgattccggtacgttttgttgcgcctcagcctgattctggttctctacggtaactgcttctttaccagtacccagatcgtcttcgcctgcctgcaccgcatcaccagcctgtttttcatcactgtcagctttttgaacctgcacattgctggtggtctccggattcgtttctgtgccatgagttgatgagttctgcattaaagcggacacgtcgaaaataccgttgccaacatttttaaccagttcaggttcggtggtcggctggcttgtcccggttttcacccattttgggtcgttcgggtcgctgatgccttccacatattcaccgcgcgcggcggcaagctgtcggttggcttcttctaccgcgtctttttccggagtgtgtcgggcagccgtgagagcttcctcggtggggttctcgtgatcagtctccgttaagttggcgttgatatacccctgaaggcgtccggggtagtgataaaactcagggtgtgcgcttcggatcagcgcgaaaatagcggcgcgggaataatccaggataccgggcgttgcgcgaagtgctgcggaccattctttgaacggactttcctttttctttacgatttcttttgcgcgacggtaaacgctgccaggtagctcatagatattaaagtccataggcaaagtggccattgcaatctctacgtccagagtatcgagagtgtgttcgtaatcagggttacggtcagtcttattgccaccgccagcgttggcgccgctttcagtgcgttgaatagccgatacacggttgcctttcgcccactccttaacgagcaaaccgcgatcgatatgctccgtctcgaaccatgttttaaggaactggataacagtcgccagttcaggagtttttccatcgacagggaatacttttttaacggcattcactattttgtgaatgtcatgttcaatggctttcttgaacgcttcaacattctcggcggcaagcagcaggttctggacatatgaattatcggtgtccatttcgagacgcagaatttcttttttctgggaggcgtcgacgtgataaagatactcaccttcacctatgtactgagcaagaacgcggtgacggagaggcatagttgcgacaacagtcagctcgggggctggggctgttgcctgggcagggctgttgctttcgttaccaaaattttcggtgtggtcttccagcacttcgcctgtttcggtatcaacaccatcgacgatatgctggcgcgccgcggcggcggcttcagatgatggcagggtgacgccggggatttgcgtccaggtcatattgtctttagcgagttgatagtaatcgcagaaagtgaggctcagttcgccttccggcggcagctcgttaacgacagggaaattagtagcgacagctttgaaataatctttcagcttcgcaccggatttaatcagaagataatccagtgttgcatttgccgcttcaaaatcatcactgcaccagagtacagcgtctttctggcctgatgatttctttgctttgcggactaaaaatacaggattagttccactcattgttttgtcctcaattcgtgtagaatggaggtgccttaacagcaccccgatatatctggttgttaggtccggttcgctttggtcggttggaccggacagggcacgcccgcttcggtgggcgttttcttaatggatggtctgataaaatttttctgagtaatcaagcttgtaacttcggtaattaccaaaccctgcttgttctccatcacttaccttgactgtgagcagcgaaatggcttttacagcacaatgaggactgtcgaactttccgagtacatatccaccgtcgagattttcgcaattgaataaagcaatgctcttattaactgctttcaggttcatttcgatttttacgatttccataatttctccagtcttaaattcagggtgtatgaagccacgccaaattaatggcgaatttttcatttcatatttcggatctactatttaactttcgtgcgccatctggtcgtattcagcacactgcctggaacaatattccttttctttgctcgccagttgcgagccgttgcgatagagaagtgtgttttttacttctttgccttcatcaatggatttgcggcagtaaccgcattgtttaagcatccggatctcctttctgcgccagcaggtagcagaggcggcggattaaaacctcaatccggttgagcgggacagcctgctgtcgagctggtctacgtgcgaaatcaatcattctcaccctcgtttgccttatcgccggccagcggaacgttttacacctgacaacgatgcgcttgttgtcgatgaaactaacgataaaaccaaaggttcgatttgtaaagcaaaaagtgcaactaaaagttctatcttggagcataaaaatagcacctaaagaggtgctacctgtatggatgagttctttggttctattttttgaggtcgttaattagatcaaaaacgttgttcttcagcagatccatctcttggaggactgcttttgtatggaggataacacgcagtttctctgcttccgggagttgattgaaaagagaaagcaatgtttcttctttttcatcaaggactctgggtttaggttcagccctttcgccttcactttcatcccctggctccatgaagaaccaatattcaggccttccggtcaccgccgataaccttttcaagcgctctccgctggctacagacgtgccagaggcccactttctcacagatgtgtgagaaagcattacgcgccgtgagaggtcagccatagaccagccgttctcatccagaacttgctggatacgcttggcgaaaatgggatgaagatttttgttcatattcacattttacaaccttcagtttctttattcattggaactattagattgatttttgttggaacctaaagttttacgtgataatctccagctaccaactcgtagaactggagagccaaatggacaaccaattaaaaatcaaaatcagtaaccacatgactcaaatgagcatcggcgaacattttggtatctcgtctcaagctgtaggcaagtggctgagaaaaggagtaattcctccccgtcgcatcctgccgttatgtgaaattcttgaatggaaagtcactcctcacgagattgacccagcagcatacccaaacccaaccgatggcttaccaagccaagaggcatcagccaaataaccatagaggatatttacccatggagaacgcaattgcacgaaagttagacccaccagaaatcaacccgattgagatagagagcgtcctgctcaaccggcttgcatcagtagggcagaaatcatacgccgagcatatgggcatcagcgagtcgacagtcagcaggcgtaaagctgagggatatttctgcaacatggcgaaagagctggcttttcttgggattcaggccgcgccaccggaagcggtactggtatccagaaactatctcacagcagtagagattctcgctgatgccgggctaaaggctgaacgagccaggccggatgcgctggggtgggactgaaaatggcagcaactaaaaaggcgaaagccgcggtgaggggtcaccaacggctttctggtgcaaaaacggtaggtaattgcggagatgagtatgtcaaataccgctgaaatatacaaattccctgcgccgataccgacgcaacaggagtgccgtatggctgatctggaaaatggctatttacgtttagctaatcagatccaggacgccttgtgtatcgttgaactatcggggcgtgagttccgtgttttgaatgcgattatccggctgacttatggctggtcgaaaaaatcagatcgtattgccaacagcctcattgcagataagacaacactgaaggtaaagcatgtatccgaagcggtgctgagtcttgcctatcgtaacatcattatcctgcgccgtattggtcaaacaagatacatagggattaatacaaacctggataaatgggcttattccaagccacattgctcaaaatgtccggtgtcttttcctgatgatgaaattgccacatggattatttctgtacctgaaaccagggatagttatccccgaaaagggggaagggcatccccgaaaacggggatagttatccctgaaaacagggatagcgttttaccccattcagccatccctgaaaacggggatagttatccccgaaaagagggaagggcatccccgaaaacagggaacaccaaagacattattccaaagacaaatataaaagatctaaccccctttaatccccctaagggaaaagtgaagtttgatccgttgagtattcctgttcccgaatggctgaatgctgcgtcgtggaacgaatgggtcacataccgccagcaatccggaaagcccataaaaaccgaactgacggtaacaaaagctttcaggcttctgaaggagtgcctggatgaaggccacgatccggtaaacgtcatcaacacaagcattgccaacggctaccagggactattcaaaccgaagttcgctctcaacgaccgaagagctggcagagatgtgaaccacatttctgcgccagacaaaaccattcctaccggattcagggggtaacgatgaaaaacgtaatcggtactggcagtgcgcttgatcgcctgaaaagaattatcccagccagtgtgcagccgaaattctcgactgctgatgagtggcgggcatggcaggaagccgaagggcgtaaacgcagtgaagagcttgacaggatgaatcagaaatcccgcaccgagaagattttcgggcgatctggcattcaggatctccatcgtagctgtacgtttgctaactacgaagtaagcggggaggggcagcgaaaagcgtacacgatggcaaaaagttatgcccagaacttcggtagtggatttgcgagctttgtgttcagcggtggtccgggaaccgggaaaaaccatcttgcggcggcaatcggaaatcatctgctggccggcggtcatagcgttctggtggtaactattcctgacctgatgctcagggttcgtgagtgctacgacggtgggcaatcagaagcgtccctgcttgatgacctttgtaaagttgacctgctggtactggatgaagtcggtattcagcgcggaagcagtggtgagaaggtcattctcaatcaggttatcgatcgccgtctctcatcgatgcgacctgttggcgttctgacgaatcttaaccacgaggggctgttggattcactgggcgcgagggttatcgatcgcctccagatggacggagggatgtgggtgaattttgactgggaaagctaccggaaaaacgttagccacctccggattgtgaaataaggggttaaaaatggcccgacctaaaacacaaagcgaacggatgattattcttgagcggattatcggtctggtgaaagagcaggggcgcatcacgacgaacgacgtcgttgcgatttttggcgtgcaccgaaccacggcggagaaatatctgcgtatcgcgctggagcgaggcggcttcattcgtcatggccgctgcggcattttccgagaccagcgtgcggtgattgattatgacctcaggcgatacagcagtagtcaggtaacgggattttcagcgctgccggtgctggagaaaagcccggtaatgcaggtttatggagcatccaaaatgagcatcaacaaggggggagcccaatgagcaacatcgacaaacgggcgcttcgtgaagtggctgagagggctacgccggggaattggcgccgcacctcatcactgttcaatggcatcacggtaacgccattttctctttgcggtgaagaagtgacgttggcccatactgttgagaaacgtgacgcggaatttattgccgccgctaaccccgccaccgtgctggcgctgcttgacgtgctctatgagtttggagaggatgaggtggccatctctgaatacgtcacaaatcttgaagatgctttgcgagttgcggcagcacctcagcaggaggaatgatagctggttaaatccacagcagaaagcaaaagcattattaggtacaatcacactaactttttgttgttaattatttgatgaattacgaggataagctcatgtatcagcgaatgatttttgaagaaggaaaagagccaaggttgtattcaagccaacatgactccaagtttatcccaataagtaataacaatggaaaagttcaaaaggttcctgttatggagctcaaggataccagaggagatgttttttatgcttacaactatgcttattctggtaaaaaaccatcaaatgacgaaatctataaggctattgatgagctaaagccaatcggtgaaaaattcgaaatgtctaagactataagcgattagataaatctgttttcaacattgcagcaaaatcacaggaagatcgagacaaagttagcatggcgatatatggaaatgtcggagcagaacaccaagaagtaagcgtaatttgaatgaatgtgaacccgccgagtacgggttttcttttatctgaacccgctgcggcgggttttttgcctaaaatgtgatatgaaacaacacactagcctttgcaaaaagtgctattcaccccttgaatattctttctaacaggtatactgtgtttatatacagtggttgaatgtagagggaattatgagaattgaacttgttatcagccgggcaaaacagcttccggaaggtgccgttcctgcgcttgaaaaagaattaattacccgtctccagaatcagtatgaaaactgcaacttaaccatccgtcgaggcagtcaggatggtctgagtatcgtcggtgctgctgatggcgataaaaaacgtatacagagcattctgcaggaaacgtgggaaagcgctgacgactggttttattaacattgcgcttaatgctggcgcgcatttttcagaatatcgcaatttgcgtatccctttgatgctgctgccgacaatttttaaccgcgtccgtgtgtcgctcaggggggttacgtggcagagggagtcctatcagatcttgctgataatttgcgggtgactataactgatgctaagggaatagaacttttgtcttttagacttgcatcaggtgatcgctatatcctatcaacccaaaacggttctgtaacaaaccgaaagctatcaagagatgatttgtactggtctaaggataccattatggaagttgtcagagagatgggctctaataattgacttaacaataagcacgcaatcataattatcgcactggcctgaacaaccagtaacctgacaattatgcgccacggagaataccatggcgcacgaattacaactcatcaagcagtcatctggaattctgatccccgctacgccggagaccagcgaaattctgcagtcaaaaattaaactcggtgccgtgctggtggctgagttccgtcaggttaggaatcctgcattccatcgccgctttttcgcgttgcttaatcttgggtttgaatactgggaacccaccggcggcaccatttctgccaatgaacgcaaactggtaaacggttatgcaaagtttctcgctgcatatggcgggaatgagagcgcattactggatgcggctgaacagtatctggaacagattgcaaaccgccgggtaacaaacggaattagcctctgtaaatctttcgatgcataccgcgcatgggtgacggttgaggctggccactatgacgccatccagttaccggacggcacccttcgcaaacatccccgcagcatcgctttttccagcatggatgaggtcgaatttcagcagttgtataaatccgcgcttgatgtgctctggcggtggattttatcacgtacatttcgtactcagcgcgaggcggagaacgccgccgcccagctaatgagctttgcggggtgatggcgatgaaatactcctggttccatcatcacgactgcacaaccgagcaggccgacacgctgatatcggattatcagaagcggggcgtaaggacagaaaagagcctgaaccctgacttcattacctggactgtcagcgcgaaattacctgaatatgcacaccgggtgcggacgccaaaatccttacgccaaaaggtctgggggtgaacatggctaaattaccgcgccgtaagtgcgcaaacaaagaatgccgccagtggtttcacccgatacgcgaggggcagatcgtttgctcgtaccagtgcgccagcgccgtcggcaaagaacagaccagaaaagctcgcgaagccgcgcaacgtaaggcgcaatcccttcagcgcgccgctgagaaaaaagaacgcgccgcctggcgccagcggaaagccgcggttaagccgctgaaacactggattgacttgacgcagcgcgccgtaaatgacatttgccgcgaaaccgaactggcagaaggactcggttgcatctcctgtggaacgaagacggcattcgcatggcatgcaggccattacaggagtacggccgccgccgggcatctgcgcttcactcgcttcaacatccatcttcagtgtgatgtctacaacgtctacaaatcagggaacatcgaagcatatcgtgccgcgctggttgagcgttacggggaggcggcggtgctggcactcgagaacaataacaccccgcaccgctggacggtcgaggagctgaaggaaatcaggctcgcggcactggcggatctgcgtgcgctaaaaaagctggaggccgcatgaaaccagaactgatcgagatactccgcatgcgctggttgcgtctccgaatttatcgataccggggatcttttcctgtggcatatcgcattcttcgtaattacgtccgcattgaagcaaaacgggagcatcgaaatgaatcttgagtccttaccgaaatatttttcacctaaatccatgatgcccggcgcagtaccatgcggaataacgtctgatacgctgactattactgacgtaatggcatctctcgggctacttactgcaaaagccgcagtgggtattgaattgtatctggcaaaagccggggttttatcttctgaaaatatcatcgcctacatcaggcaattagcagagcagcgtgcagaacggcatggggcattacggaaaatggaaaagggtaagcgctcaaaatttctcgacactatggcgcgttatgtatttcgcgattattccctcagtgcggccagcttggtgacgtgcagtagctgtcatggtgctaaattaattgatgctgaggttttcacgaacaaggttacttacccggatggtaagccaccaaaatgggtaaaagatacgaaaggtatttctccgtccgactgggaggtgtggaaatcagttcgtgagcaggtgcgcgtagtgtgtaaggcgtgtgatggcaaaggccatgtgaaaaatgaatgtcgttgccggggacgcggagaaattctcgataagaaaaaatctgagttgcagggcgtgccggtttataaaaaatgcccaagatgcaagggaagaggctacccacgtctcaaagataccgagatttttaaagcactaggagtaacggaaatggtatggcggtacaactataaactgtttttcgatcggctggtggagcattgccatattgaggaatcgtatgcagaaaaggttctgggaaacgtgactcgatgaccaaaataatttagctattgcaaaattaacggaaaatggctaatctgattccaacgatgggttattatgcctgtgacgttacaagaattaagaacctcgcctcggcggggtttttgttttttttggtggtatattcccttggtgtcaaatcacagggggggcgatatggggttctattacgtttttcaatacaagccgaaagggatgtcgtcgggtaagcatttaaatgtttccgaggagttttcggaccggaatgaggcaaagagagcgaagtccaggcacatgattaatgatccagattgtgtcttctcgggaatcgtgcaggctgattcgccggcagcggtacttcaagaagtacaggctgaatctcttaataggctttaacggatttaacttggcagtatccacattaccaatttcattaggtcgcttcggcggcctttttctttttcaggcaccgggcatcatccgctacgtgcttggttgataaatccagcccgtgaagcctgcccctttcatcacacactgcgccatccgagctatcggaggtgaggcttatgaaaatgcacaacgatccccattcaatggactcacaatctatttttgctggctcacaattactgccaatggaaaaaacttctcatttggctctgagcgtcggatttcgctctcacttagcgtgagtccacgtccgatttcagttgcagttattgtgagccaaaatttgcgctgattgcgagtctgacttttttcgattgtgagtcgttacagatagccgccgggccagacaccacaacggtaccaggtggcgttatgtgctagaaaccgaaattcttgaacatctcattactactcatatcgttggctggcgcacggttcatcgactccatctgcttaatcaaccctatgctagcaccaacaggccccccgacgctgaaaccgacgctgctggagcgggttttgctggtgctactgctgtgggtttgactacgggtgttacagttgctttggtgtgtccgtgtgagaccattttcgttgagctggctatcttcactttgggtgcagtttccctgtgactggctgtgactgtctcctgtggtgtggttgcggctatccgtgtgccactcgctatagcctcccgccggcgcaatgattccgaccgatgtaccgtgggtggcatagggaggcatgaccatgccactacagccaccgagcagtaacgcggtgccgacgataaaaatgaacttacccagagcggtgtttttcattagttcctacctatttcttctcgttggttatttctatgccctgccttggcagggctcgctattattcattcttcaactgtgagatcaagttattttaattaaatcggtattattcttaattgtgttctttatgaataaatatcctccggctatgccggaggatatttattatttcctctcataactgagaggccccacacaaccagagggggatgaatgtccgaatcgatttctggtactgggttagcaggtggcatcctgacaggagccagtgtctatggactgctgacctgtattagctcagacctgaactggttactgtgttgtagcatcgtgggattttgcattttttgatgagtgtcaattactaaattcgtaggcgattcttggtggtgatgtgtgacccatctcttttaaaatgatattggtatactcgactaccgggcctcttggattactgtcttctttgtcctgaaggtgagtcaacgcgtgtacaacttcatgaataaatgagcgtgttgtatcaaattgttgtgggccatcattactttcatagtactctggtattgaatcatcgtctgtatcatccaggttgagggcaatcacttttctgccttctgaactctccaggtcctcatcagttacggtagtaccaaagttttctccggctcccagcaaccagcgttgttctacatcatgcaattcctggtcgtaggcataattcatcagtctgcggaatgtcccgctttgagtgtatgcatcttcaagtatgcgtgatagcacctcacggcattcatcataggtatcatcatcaatttcgatatcaggatccattcctcctggtccagagataaggtattcagcaagacacattggttccagcctggctttatcatcggtagcaagaccatcatgttggaggcgtaattgcgaaggattatcttggtgttctggaaggtctggaaataccttgctgtcatgaggatgggataatccatatgttgacatcatattattgataaatattggtttaattcccgttggcatgatgagttacacatcctttttattacatggaattaacattctataaatagcatgtttttgtcaaacagaattcactcagcacgcaatcaattaaactaaaagctaaatttgcagtatttgtgcctcacctccattaaaattgtactctgcgtgattttactttcagattctgcaaccacaggcaatcctgttttacaagatattaaaccctgcaacccaaccatttcactcactctagttaccatccgaaatcatcggaggtgaggcttatgaaaatgaatgacaagactcctgaattctgggctgcggttttgaccggactcaaaaatgcgtggccccagatacttggggcgttaatggccggactcattgcctacggccgactgatatacgacggcgccacccgtaaaaataaatggcttgagggcgtcctgtgtggcgctctttccttatgtgtcaccagtgcgcttgatgtggtaggcctgccggtttccatttcgcctttcgttggcggaattattggctttgtcggtgtggacaagctgcgcgaaatcgcaattagcgcactcaaaaaacgtgcaggggttaatgatgagaatcagtgaaaaaggcattaccctaatcaaagagtttgaaggttgtagcctgacagcttatccggacccgggaacggggggagatccctggacgattggttatggctggacccactctgttgacggtaagccagttaagcccggaatgatgattgacgaggctactgccgagcgcttgcttaacactggtttagtcggttatgaaaatgatgtgtccagactggttaaggtcaagttgacgcaaggccagtttgatgcgctggtgtcgttcgcgtacaacctcggcgcccggacattatcctcatcaactctgctgcggaagctaaacgctggtgattacgctggcgccgctgatgagttcctgcgctggaataaggctggtggcaaagtactgaacgggcttacccgtcggcgtgaggcggagcgtgctctgttcctgtcatgatgttcaactggaaaacgatgtttgttggcctgttgcttgtctcgctaattgttgccggtcggctggcaaatcactaccgaaataacgccatcacctacaaagagcagcgcgataccgttactcataggctgacgctggcgaacgcgacaattaccgacatgactaagcgccagcgtgacgttgccgccctcgatgaaaaatacacgaaggaattagccgatgcgaaagctgagaatgatgctttgcgcgatgatgttgccgctggccgccgtcgcctgtacgtcaacgcaacatgccccgcagtgccgacaggtaaatccacctccaccgcccgcatggataatgcagccagccccagactggcagactccgctcaacgggattatttcgccctcaaagagcgagtgaagacgatgcaaaagcaactggaaggggcgcaggcgtacattcgcacccaatgccacggtaatgcaggaaaaactagtaaccaatggtgactgtattaaaaaggtactcccgggcagggggcgccacgggtggcttcgggctcgcgggaatcggctgatttttgattttttagtctctgtcagcactgaaaaataaccttaaaaatcaatacatttactgttttcagtgtcgaagtggtacgttttttgttcgacactgaacgccattttcaccgtatacaggaaaagagcacgactgtggatcaggaaattaaaagcctcgaattaaacatcacacagctttcggccatcactggtgcacaccgacagaccatcgccagcaggctgaagggcgtaaaaacctcaggtgggaacggtagtaacctgaaaatctaccggctggtggatattctgaccgccatgatgacgatgccggctgttaccggggagaatgaccccaataagatgaaaccctcagatcgacgggcatggtttcagtcggaaatgacgcgtattgagctggaaaaggagatgagaactctgatcccggccagcgaggtgctgagcgtttatgctgtcatggcaaaaacggtcgtcaagacactggagatactgccggacttactggaaagggatgcggcattgccgcctgatgcgctggaaatgacgcaaaaaattattgatcaactcagggaagatctggccagcatgacataccaggcctgcgcggatgctataaacggagatgatgatgacaacggtgacgaagggcaagaggaagagcaggaatagtttagcctctgccgttgttgccggatgtgatatctcatcgatgttcaggccgccgcgcaggatgaaaatatcggatgcggtcagaaaatatatgcgcgtaccacgcgatgcgggaaattctgtggcatgggaatccaccctgaccccctatgtggtggaagccatgaactgcctgtcatcacgcagctacgatgccgtggtatttgtcgccccggcaagaaccggtaagacgctggggctgattgacggctggatttcctacaatattgtctgcgatccgtctgacatgctggtggttcagatgactcaggacaaggcgcaggagcactcaaagcggcgtctggcaaagatgtttcgccacagtccggcgatagcaagaagactcagccctcaccgtaacgataataatgtgcatgataaaacgtttcgtgatggctcgtttctgaaaattggctggccatcaatcaatgttttttcgtcttcggattttaaatgtgtggcgctgactgactacgatcggttccccgaagatgttgatggtgagggggatgcattctcgctggcgtcgaagcgtaccacaacgtttatgtcgctgggtatgacactggtggagagctcgccggggcgggaaattaccgataccagatggaaaccgtcatcaccgcacgaagcaccgccgaccacaggaatactttccctgtacaaccgtggcgatcgtcgtcgctggtactggccgtgtccgcattgtggcgaatattttcagccatcaatggcgaatatgaccggctatcgccatattgccgaccctatggaggccagtgaagcagcgcggattcagtgcccacactgccataagttgactgaaccacagcagaagcgtgagctgaataatcgtggcgtctggttgcgggaaggtcagcacattgaccgcgacggcaatattaccggcgaagcccgccgctcacgtatcgccagtttctggatggagggaccggcggcggcttatcagacctgggcgcaactggtttacaagctgctgaccgccgaagaggaatacgaacgaaccggcagcgaggaaaccctgaaagccgtcatcaatacggactggggattaccctatcagtcccgtcgctcgctggaggcacgcagcggtgacgcgctgatggcacgcgctgaggacgtatcaaaacgtaccgtttctgacggggtgcgttttattgtggcaaccgttgacgtacagggcggtaaaaagcggcgctttgtggtccaggtagtgggctatggcgcatatggtgaacgctggatcattgaccgctacaacatccgttattccctgagagtgaatgaggatggcgaaagccagcctgtcaatccggctgcaagaccggaagactgggatttgctgaaaacggatgtgctggaaaagacgtatccgctggcggcagatcctgaacagtttatgccggtactggcaatggcggtggactcaggcggtgaagacggtgttaccgataatgcctacgcgttctggcgaaggtgtaagcgaaaaggcgttgccgggcgcgtttatctgttcaagggagacagtacccgacgcgagaagctgatcaccaaaacctatcccgataacaccgaacgctcagaacgtcgggcaaaagccaggggggatgtgccgttgtatctgttacagaccaatgccctgaaagacagggtagctgccgcactggagcgtgaggagccgggggcgaattacattcattttcctgactggctggggccgtggttctacgaggaactgacctatgaagagcgcagcgcagacggaaagtggaaaaaaccgggacgcggtaataacgaggcgctcgatctgatgtgttacgcccacgcgctggctattctccgtggctatgagcgaatcaactgggaaaaaccaccaggatgggctcgcttaccggaaaaagacgccgcaaaaaccacgcagcctgttgaggttcgccagcaggagcaacacgaaggaggagagaaagccgtgaaagccaggaagaaaaaaattttacccgcctggggcggtggttccggaggagggtggttatgaccagggcagggctacaggagttgtacaacgcctatctggaggccgagcttgctgtactgaaaggcaagtccatcatgcttaacggtcagtcaatgacaatggaaagcctggaggaaatcaggaaggggcgccgcgagattgaagacaggttacagcggttaaataatccgcgacggcttttcacccgggcgaggttgtcatgaattttatcgataaagctatcagcatgatgtcgccgggatgggctgtatcaagactccgatcgcgggcagtaataaaagcttacgaggctgcaatacccacccggacacataaaattaagcgtgaaaaccgcaacgccaatcaactaaaccagattgccggaaagtccctgcgggagcaggcccgctggttcgataacaatcacgatctggtggtgggggcgctcgataagatggaagagcgcgttatcggggctaaggggatcatcgttgagccacaaccactgacggtggccggaacgctgaataacgcgctggcggaacaaatccgcgccagatgggcagagtggtccgtgtcgccggacgtgaccggacaatatacgcgcccggtactggagcgccttttgttacgcacatggttgcgggacggggaggtgttctcccagatggtggcgggaaaaatgccggggcttgagccggtggcgggcgtaccgttctggcttgaggcgatggaaccggattatgtcccgatggaacagacggacagtacaaataatctgattcaggggatctattttaacgactggcaaaggccaaaaagttacatcgtctgtaaatcctggccgggatttgccaccgctatggtggccaccaagcttatcgatgcagaaaatatgctgcatcttaaattcacccgtcgcctgaatcaggcgcggggcgtcacgctgctggcgccggttattatccggctgctggatctgaaggagtatgaggacagtgaaaggctggccgcgcgtatttcggcggcttttgccatgtttatccggcgcagtgacgcaatggtacaggatggtgacgcgccagattatgcggataaagaccgcgatctggatattgaacccggcaccattctgaaagacctgttgccgggagaggatatcggcaccatcaaatctgacaggccaaatgccaacctggagtctttccgtatggggcaactgcgggcggttgccgcaggtgtacgcggaagtttttcttctattgctagaaactacgacggcacctacagcgcccagcgtcaggagctggtggaggctcaggagggatacgccattctacaggataattttattgctgccgtcagtcgcccggtttaccggcgatggctggcgacggcgattacggcgggtgtgatagatgtgccgacggacacggacatggcgaccctgtttaatgccgtgtattccggtccggttatgccgtggatagatccgctgaaagaggcgaatgcctggaggatactgatacgcggcggggcggcaacagagagtgactgggtgcgtgcccgtggcggcgcacctgctgaagtgaaacgccgccgtaaggcggaaattgacgaaaaccgtaagctgggactggtatttgatactgatccggcacatgacccgggggaacaggataatgccggaagtgaagacaacagtggcggcgataaaaatgccgccggtgatgacagcagggaacggacgcggggagggaagcagtaatagctggtattccatcagggctgcagccaataacacggcggaagtccgcatttatgacgagattggtggatggggaatttcggctcgctggtttgcagaagaactggctgcactgggacagattaaccggataaatctgcatattcattcacctggcggagcagtactggacggaatagccatttataacctcctgaaaaatcatccggcgcaaaaaacggtgtatatcgatggaatggcctgctcaatggcatccgctattgcgatggtaggtaatcccatcattatgccggaaaacgccatgatgatgattcataagccgcgcggagtggcggggggtgaggcggaggatatccgggaatatgctgacctgcttgacaagatcgaaagcgtcattatccccatctataccgaaaaaactggaaaaacgcctgaagatattgctgccatgctggcaaaggagacctggatgagcggcgcggagtgcgtcagtgaagggtttgccgacaaactgatacagcctgtaaaagcaatggcctgtattcattcaaaacgtgttgaggagtttgagcatatgccacagagcattaaaggtatgattatcgccccgcagggcaatgcaggcgcgcaaccgcagccacaggcaaaagcccctgagtcacagattcagtcgcaggctcagtcgctggtgactgtagatgaaaatgccattcgcgcacgcctgcaggaagaacagcgtaaccgtatcaccggcattcagaatgtgttttcactttccggcgatcgttatgcctcgctgatggcaaagtgcattgctgatgtggattgctctctggaaatggcgaaggacagactgttggccgagatggcgaaaggtattacgccgactaaccagctgaatggtccgcagaatcgcgcagagtttcatgccgggatgtataccggaaacggtaatattaccggcgacgccgttcgcgctgccgtgatggcccgcgcaggctatgaagaagcgcagaaggataacccgtacaactgtatgaccctgcgtgaactggcgcgaatttcgctggtggcgaggggtacaggcgtgtccagcatgaatcccatgcagatgatcggcatggcatttacgcacagcacctccgatttcggtaacattctgctggatgttgcaaacaagtccattctgcagggctggcaggaagcgccggaaaccttcgatgcctggaccaaaaaaggacagttgtctgatttcaggattgcgcaccgtgtgggtatggggggattcagttcactgcgtcaggttcgtgaaggagcggaatacaaatacgtcaccacaggggataaacaggcgaccattgcgctcgctacctatggggagctgttcagcattacccgccaggccatcatcaatgatgatatgaatatgctgacggatgtcccgatgaagctgggacgtgcggcaaaagccaccattgccgatctggtttatgacgttctcatcagtaaccagaaactgtccagtgataatgtggcgctgtttgacaagacgaaacacgcaaacgtccttgaaaaagccgttatggatgtggcgtccctggataaagcgcgccagctaatgcggatgcagaaagagggcgatcgccacctcaatatccgtccggcatttgtactggtgccgacggcgatggagtctgtttcaaatcaggtgattaaatctgtcagtgtcaagggggcggatattaacgccgggatcattaacccggtgaaagatttcgccacggtgatcgcggagcctcgtcttgatgacgccagtcagtccactttctatcttactgcagcaaaaggcagcgataccgttgaggtggcttaccttaacggcgtggatgagccgtatatcgaccagcaggaaggattcacggtggatggcgtaaccacgaaagttcgtattgatgcgggcgttgcgccggtggattatcgcggcatggtgaaatgcaccgtataacccactaaaagcagacattaagcgatacggccctgacgggctttttttatacctgaaatccggcacggcgtgccggaaaggagaataaccgtggctaagaattacgtggaagacggcaaaacgattgaaattgtggcgaccacgtcactaaagagcggagatctggtacaggtcggcgatatgttcgctgtggctgttaccgatattgccgccgggagcgccggaaccggcatcgcagaaggggtattcagcataccaaaactgacaacagaggatattgccgtcgggaaaaaagtgtatctgaaggataacgtggttcagacggatgcaaccggcagcctgccgtatgtcggggtggtatgggcgccagcggcaaacggtgatgaaaccgttccggtaaaaattaatggctgacctttttgacgggatgaaaaggcgcatggatgcacttatcgcagaacgcttcggcatgaaggtcaacatcaacgggactgactgcatagtggtggagtctgattttctggctgaactggggcctgttgaaggaaacggaaaaaacgtagtggtgttttcaggcaacgttatcccgcgccggggagacagggtggtactgcggggcagtgagtttaccgtgacccgtatccggcgttttaacggtaagccacaactgactctggaggagaacaatggaggtaaaggggcttaaagaggccatttcagtacttaaagaacttgatcgtggatatgtgacccgggcaaaaattcgggccattaaccgggtggcaaaacgggtggtcagcgtgtcagttcgcagtgctgctgctttggtggtggccggagacaaccgacggcagggtattcccgtcagaacggtaagacgtcgcgccagagtcaggctggccagagcggacaagccttttgccaacatttatgtgaactgtgatccgctgactgccatcaggttactgagttcgccaccatcaaccccgatgagggggagaaaaggtaagccgctacgtataggaaaataccgttttgaccgggggtttattgcgcaggctccgaacggatggtggcaggtatttgagcgttccggtgccggaagatacccacttaatgtggtgaaaatcccggttgctgatgcattgcgccatgcgttcaacacgcaggttgttttacagatgaaaacggagatgcccaaagagctgaagcatgaaatcagttatgaactgaggagattcactaaaaaatgacccgacacagtgcagtacggcaggccattattgccgcattaaaaaagaccgatgatggctccaccacgttttttgacggtcgtccggtcgtggtggaggaggatgagttacctgcggtggcggtgtacctgagtgatgctcagtataccggtcctgaggtggacggtgatatctggagcgcggtgctacatgtggaagtatttctgaaagccactgcaccggacagcgccctggatgaacagatggagaacagggtgtatccggcactggggagcgtggcgggactgggtgacatcatccggacaatgtcggcgcaggggtataactatcagcgagacgatgaaatggcgatgtgggggtcagccgatctgagttacgacatcacctattccatgtagaggaaaagagaatgacagacacgacaattcctaatccacttgcgccggtaaaaggcgcaaataccacattctggatgtacaacagcgagggtgatccgttcgccagcccgctaagtgataataactggctgaggctggcaaacgtaaaagacctgcagccgggagaactgacggcagatgcagaagataataactatcttgatgacgagaacgctgactggaaaagtaccacacagggacagaagtctgccggggatacttctgtgacgctggcgtggaagccaggtgaggacgtacagaaaaagcttattcaactgttcacgaccgggcagaagcgcggattccggatcaagtatccgaacggcactgttgatgtgttcagaggctgggtgagctcgctggggaaaacggtgcagagtaaggatgagatcgcccgtacagtaaaaattaccagtgtgggccgtccgtacatggctgaagaggatgcaccggaagtggttagtgttaccggactgacagtggaaccgacaaatgccaccgtgaaggtcggcgccacaacagcggttacgttcacggtgaaaccggataacgtgacagataaatcactgcgtatcgcaacgtcagatccgactacagccaccgtcacgcaggcggaaaatattgccactgtaaaaggtgttaaggcaggtacagtgaaaattattggcatgacaacagacggtaattttaccgctattgcggatattactgttcaggcataacccacctctcgtcctgttttggggcatttttttcaggaataaatcatgtttttaaagaaagagacgtttacccggggggatgcgtcggtggcattgttcgagttatccggcctgcaacgtattgagtacctggagttcatccagaaacgtactgcgaaatatgacacggatatggatggtacgacggaagcggataagcgcgtggcttatatgcaaatggcactggaaattaatgcctggctggtatcccgctcgcttctgaatggtgattcttctcaggatgcagacacgctttatcagtcagtacaggcgaagtggtcgtatgaggcgctggacgcaggcgcagaaagtgttctgatgctcagcgggctgtctgcggataagaaagataacgccagtgattcaggtaatgaatcagaggacatgacgccggaaaagtcctgaataatgagcttcattttgtccggcaactggcccgggagttccggcggcctgactggcgccggatgctggacgaaatgagttcaactgaacttagtgagtgggctgatttctttcgggaaaacagtttcagtgatgccctgctggatgcggagttttccacgctgaaagcgcaggtgttcatgctggtgacggggaaagaaatcgatgcagcggacttcagtttgctgacattacccggagcggtacagagcatgacggagcaggatctgcttgaagtggcagtcggtattccgggaggagtgagatttgagccagaaagtcggtgatatcgtcatcaacatggatgttgatacagctaaagttgccgccggtcttcagactgccagtaacgggctggggaagctggtggacagcagtgatctcgttgaaaaacgcatcaagcgatgtatggagtccagcgccagaagtgtggcggcatcggcaaaaagtatcagtgccgctatggcgcaatcacaggttgccacacgcacacagagtgacgctatggcacaactggcgcgtgaggcgaacgaggccagagaaagggctgtcgacctgaatcagaagttaagggcggaagctgcgcaggcagcggtggttgcacaggctcaggatgcagccgcagcggcattttaccgtcagattgacagtgtaaaacagttaagcggtggtctgcaggagttacagcgtatccaggcgcaggtacgacaggcgaaaggacgcggagatatttcacagggcgattatctggcgctggtgtctgaagctgctgcaaagacacgcgaacttaccgatgcggaggcgctggccacgcagaaaaaagcacagtttatacgtcgactgaaagagcagacggcggtacagggcctctcccgtactgagttgctgcgggtgaaggcggctgaactgggggttagcagtgccgccgatgtctatatccgcaaactggataccgcaacaaaatccactcatgcactaggactgaaatcagcaatggcgcgccgcgagataggcgtactgattggtgaactggcacggggaaattttggcgcccttcgcggttccggtatcacgctggccaaccgggccgggtggattgagcaactgatgtcgccgaagggcatgatgctcggcgggctggttggcggtgtggctgcggcggtttacggactgggtaaggcgtactatgagggggcgaaagaaagtgaggagttcaataaacagcttattctgaccggaagttacgccggaaaaaccacaggcaagcttaatgaaatggcgaagtcgctcgccggaaatggcgtcacgcagcacgacgcggcaggagtactgacccaggtggtcggtagcggagcgtttaccgggcaggcagtggcaatggtatcccgtaccgcggccagaatgcaggaaaacgtggggcagtcagtggatgaaaccatccgccagtttaaacggctgcaggatgatccggtgaacgcggcgaaagaactggacagggcactgcattttctgactgccacccagcttgaacaaatcagggtgctcggtgaacagggaagaacggctgatgctgcgaaaattgccatgtccgcgtattcggaagagatgaataaacgggcgggtgacgtacatgataatctgggctggatcgagaaggcatggaatgccgtgggtgatgcggcgaagtgggcgtgggatcggatgctggatatcgggcgggaagatacgctcgatgaaaaaatcgcgacactgcaggaaaaaatcgcgcgcgccagaaaaacgccatggacagtgtcttcctcccagactgaatatgatcagcagcaactgaacgaacttcaggaacagaaacgccagaaggacctgctggatgcgaaggcgcaggcagagcgtaattatcagaagactcagaagcgccggaacgagcagaacgccgcgctgaaccgggataatgaaactgaatccctgcggcatcaacgggaggtggcgcgcattaccgccatgcagtatgccgatgcagcggtacgcaatgccgcgctggagcgtgaaaacgaacgccataaaaaagcaatggcacggcagaaggaaaagccaaaggcttactacaacgacgaggccgggcgactgcttttgcagtacagccagcaacaggcgcagactgaagggctgattgccgccgcgaagctttccacgaccgaaaaaatgacggaagcgcataagcagcttttgtcatttcagcagcgcatcgctgatttgtccggtaaaaaactgacggcggatgaacaaagcgtactggcacataaggatgaaatagcgcttgcgctacagaagctggatatctcacaacaggatttgcaacaccagaatgcctttaatgaactgaagaaaaagacgctcacattaaccagccagctcgctgacgaagaatcccgcgtcaggcagcagcacgcactggcgctggccacaatgggtatgggcgatcagcaacgtggccggtacgaagagcatctgaaaattcaacagcactaccaggaacaactggagcagcttaagcgcgacagcaaggcaaaagggacatacggttctgacgaataccgtcaggcggagcaggaacttcaggccagtctcgatcgccgactggctgagtgggcggattataacgcgaaagtggatgctgcgcagggagactggacgcagggcgcgtcgcgggcgctggataactttctggcgcaggggggcaacgtggcaggcatgacggagaacgttttcacaaacgcatttaacggcatggcggacagtatcgcgaattttgccgtgaccggaaagggcagtttccggagcctgacggtctccatcctggctgacctggcaaaaatggaggcacgtattgcggcttctaaactgttgggttcagtactgggtatgttcgtctttggcgcatcagcaggcggaagtacaccatccggggcatacagttcagcggcgctgtcggtcattccaaatgcggacggcggcgtgtaccgctcagcaggactcagtcagtacagcggcagtattgttaacagaccgacgttctttgcatttgccagaggggcggcagtaatgggagaggccggtccggaggctatactgccgcttcgtcgcggtactgacggtaagctgggggttgtggcagcaggttccggagggatggcgatgtttgcaccgcagtatcatattgcaatcagcaacacggggccggaactgacgccgcaggcgctgaaggcggtttatgatctgggtaaaaaggcggcggctgatttcgtgcagcagcaggggcgtgacggcggcaggctgagcggggcatatcgatgatgaaaacctttcactggaaagttgacccggacatgggggtggattcggaaccacaggtgtcggtggtgaggttcggtgatggctacgagcagcggcgtgcatccgggatcaataatgacctgaaaaaatacagtgtgactatccgcgttgaccgggaggatggtccgggactggagggctttttgtcacagcataacggtgtgaaggcgtttttgtggactccgccttacggataccggcagattaaggttgtctgccggaaatggagtgtgaaagcgggattgctgaaaacaacattcaccgcgacatttgagcaggttatttcttagtatttttgatcgaaacgatcgataaatatgattgaactttctaacctgctgctgtttcactgagcccgcacagtcaataatcaaaaaaaggaaatgttatgaaaaagattgtcgtggcggttttagttggtctggcgttaggtagcatcggcgtggctaacgcagcagggtataaaaataccgtttcaattggatatgcctacacagatttaagcggctggctttccggtaatgcgaacggtgccaacatcaaatataactgggaagatctggacagtggattcggggcgatgggttcagttacatacacctcggctgatgttaataactatgggtataaggtaggtgatgctgattatacctcccttcttgttggtccttcataccgttttaacgactatctgaatgcttacgtgatgattggtgcagcaaacggacatattaaggataactggggaaattctgacaataaaaccgcctttgcttatggggcaggtattcagcttaacccggttgaaaatattgccgttaatgcgtcttatgagcatacaagtttttccactgatgctgacagtgacgtcaaagctggaacctaggtgcttggcgtaggttacagcttctgacctttaacatcgatacagatttaatgccctccagtgagagggcttttttatgggtaaaacgaaattatgacgatatggctatgttgctgttatttctcaatgacaccacaggcaaaacgtgcaccgccaccacccagtggagcaggtttatcggagtaattgtcaccgcctttatggatcatcaatgagtgacctttcagttctgacagtgatttaaggcgtggtgccagtaacggatacgtggctgtaccatctgcattgacaaccagtccaggcagatcccccaaatgccctttgtcattatatgggccaagatgtttcccggttttttcggggtcaagatgtcctccggccatgagcgccggaacctctttaccgtctttcattcccggcatacaacttgggtttgtgtggacatggaagccgtgaattcctggcgtaagaccatttaggtgaggagtgaaaagcagaccgtaaggtgtctctgaaactgtgatttcacctatgttttctcctgttccgctggacagggcatcgttcatctttacagtcagggtattctctgccattgctgaacaactgatgagcgcaccagctaccagcgacaatattgtgtatttcattagttacctcgttttttggttgtatcgtaaataccattaataaaagcaggtatatgtttgcaagataaataataaaggatctctcatatatgcaggatataccacaggaaaccctgagcgagaccaccaaagcggagcagtccgcgaaggtggatttgtgggaatttgatttaaccgcgattggcggtgagcgctttttcttctgtaacgaaccgaacgaaaaaggcgagccgttaacctggcaggggaggcagtacgaaccgtacccgatacaggtacaggattttgagatgaacgggaaaggcgcatctccccgcccgaacctcgttgttgccaatctctttggtctggtcacggggatggcggaggatttgcaaagtctcgtcggcgcgtcagtggtaaggcatcaggtttacagcaagtttcttgatgcggtgaatttcagtaacggcaatccggacgctgacccggagcaggaggcggtagcgcgctataacgtggagcagttgtcagaactggattcatcaactgctaccattattctggcatcaccggcagaaaccgacggttctgtggtgccggggcgtaccatgctggcggactcctgtccgtgggattaccgggatgaaaactgcggatacgacggcccgcccgtggccgatgagttcgataagcccacctcagacccgaaaaaggataaatgcagccactgcatgaaaggctgtgaaatgcgtaacaatctggtgaatgccggatttttcgcttccatcaacaaactgtcttaacaggttcccatgattaacgatgacattctggcacatgcccgacagtgtgcgcctgcggaatcgtgcggttatgtggtcagaacggcacagggagagcggtattttccgtgtgaaaatctgtctgctgaacccacgatgtattttcgtatatccccggaggattacctgaatgcccggaaccgcggcgacatcgtggcgctggtacacagccatcctgacggtaagccctgtctcagcagtgcggatcgtaccctccagatacaaagcgggctggactggtggctggtctgtgataacaggatacataaattccgctgcgtgccacacctgaccgggcggcagtttgagcatggcgtgacggactgctacacgctgtttcgtgatgcctaccatctggccgggattgatatgccggatttcgatagggaagatgactggtggagtcagggtaaaagcctctatctggatcacctggaggcggcgggattttaccgggtgaatccggaggatgcgcagcccggcgacgtgctgatttgctgttttggttcaccgacgcccaatcatgcggcgatttactgcggcaacggtgaactgttgcaccatattccggagcagttgagtaaacgagaggggtataacgacaaatggcaacgacggacacactcaatatggcggcaccggcaatggtgcgaatctgcctttacggggatttacaacgatttggaaagcgcatcagcctcagcataaagacagcggcggaaggcatacatgcgctggcgatacaactccccggattccggcagcgaatgaatgagggctggtatcaggtccggattgccgggagcgatatggcgccggatacccttactgccagactgaacgaatcgttaccgccgggggcagtggttcatattgtaccgcgtatggcgggagcgaaaaacggtatctggcaggtggtagccggggcagcgctgattggcgcgtcatttattcccggtctgaatgctgtagcggcggcagtattgttttccgcaggaaccagtatggcgctgggtggtgtggcgcagatgctgacacctgtacccaaaacaccgacggtgggtcaggcagataacgggaaacagaacacgtacttttcttccctggaaaatatggtggcccaggggaacccggtgccggtgttgtacggtgaaatgaaaatcgggtcacgggtgatatcgcagatgatgagtacccgggatgagagcacgtcgggaaaagttgtggtgatcggctccccgttacaggcaaacaccacgtcgcggcaggacggcgggattaccagaccgtctgtcgtcatccggcagtgataatcatgacaacatgagctgatacacatgaccgccattacggcggttttgttatttatggagccaggagaatgagcaaaggtggagggaaggggcatacaccacgtgaggcgaaggacgatctgaagtccacacaacaactgagcgtgattgatgccctcagtgagggaccgatagtcggcccggtgaacggtctgcagagcgtgctgattaataacacgccggtggtggacgcggacggtaacagtaatattcacggcgtgaccgtggtatatcaggtgggggagacaccacaggcaccgctggaaggttttgaggcttccggcgcggaaacggtgctgggtgtggaagtgaaacacgataatcccgttacccgtactgttgtctcagagaatgtcgaccggctacgcttcacctttggtgtacagatgctgcaggagaccacggacaagggggaccgtaacccgtcctccgtgaatctgctgatacagtttcagcgtagcgggatctggaacacagaatttgatatcactattaacggcaagatcacaacacaatatctggcatcggtagtggctgataatttaccgccgcgcccgttcagtgtccgcatggtcagggtgacaccggacagcaccaccgacaggcttcagaacaaaacgctgtggtcgtcgtatacggaaatcatcgatatccggcagggttatcctggcacagcggttgccggtctgctggtggatgcggaacagttcggcagccagcaggtcacgcgtaactaccacctgcgcggacgtatttttcaggtcccctcaaactatgacccggatacccgcacatataccggcctgtgggacggggcgtttaaaccggcgtacacgaataacccggcgtggtgcacgatggataaactgacccacccccgttacgggctgggcaggcgtatcgggggggcggatgtggataaatgggcgctgtacgccatcgcgcagtactgcgatcaaccggtgccggacggatttggcggcacggaaccccgcatgacgcttaatgcgtatattaccacccagcgtaaggcgtatgacgttctggcggatttctgctcggtgatgcgttgtatgccggtatggaatggccgcaaaatgaccttcatccaggaccgcccctccgataaagcatggacctacaccaacggtaacgtggtgggcgggcgctttaaatacagcttcagtgccctgaaagaccgccataacgcggtagaagtgagatacaccgatccgctgaatggctggcaaacctccacggagctggtggaagaccatgcctcacaggcccgttatggacgcaatctgctgaaaatggacgcgttcggctgtacctcacgtggacaggcgcaccggacggggttgtgggtgatgatgacggagctgctggaaacgcagaccgtggatttttctgtcggtgcggaaggtctgcgtcatacaccgggcgatattattgaggtctgcgacaacgattacgccggggcgtcggtcggtgggcgtatcactgacctggatatttccacccgcacgctgacgcttgaccgggaaataacactaccggaaagcggcgccaccacgctgaatattgtcgggcctgacggtaagccgttcagtacggagattcagtcgcagcccgcaccggatcgggtggtaacgaaagtcctgccggaaaccgtgcagccatacagtatctgggggctgaaactgccctccctgaagcgccgccttttccgttgcgtgcgtattaaggagaatgacgacggcacatacgctatcactgccttgcagcacgttccggaaaaagagtccatcgtggacaacggggcgcactttgacccgttaccggggaccaccaacagcattattccgcccgctgtgcagcatctgacagtcagcacggataacgacagtaccctgtatcaggccaaagcgaagtggggcacgccgcgggtggtaaaagatgtgcgttttgtggtgaggctgaccacaggcagtgggaacgagggcgatccggttcgtctggtgacaacggcgacgaccagcgaaacggagtacgccttccacgaactgccactgggtgactacacgctgacagtcagggcaataaacggttacgggcagcagggtgaaccggcgtccgtggcattcagtattcaggcaccggaagcgccatccacgattgagatgacgccgggttattttcagataacggtgacgccgcaccagactgtctacgatgccagtgtgcagtatgagttctggtactccgccacgcaactggcgactgccgccgatattcagtcaaaagcacagtatctgggcgtcgggtcattctggataaaggatggactgaaaccactgcatgatgcctggttttacgtgcgcagtgtaaatctggctggaaaatcagtatttgcggaagcatccggacgtccggggatgacgcgaaagggtatctggatttttttaagggactgattacggagacgtatcttggtacggagttgctgaaaaaaattgacctgacggagaataacgccagcaaactgcaacaattttcgaaggagtggcaggacgctaacgataaatggagcgccacgtggggcgtcaaaatagagcagaccaaagacggcaaatattatgtggccggacttggactgagcatggaagacacgcctgacgggaagataagccagttcctggtggcggcggatcgcattgcttatattaacccggcaaacggaaacgagacgcccggattcgtcatgcagggcgaccagataatcatgaatgaggcgttcctgaaatacctgagcgcgccgaccattaccagtggcgggaatcctccggcattttccctgacgccggatggaaagctgactgcgaaaaatgcggatatcagcggccatatcaacgctgtatctggctcgtttacgggagaaatcaatgccacctccggtaagttttctggcgtgatagaagcaagagagtttgtcggtgatatctgcggctcaaaagtcatgcagggcgtgagcatcagggcgacgaacgacgaacgcagcacctcaacacggtataccgacagcgccacctatcagatagggaaaaccatcacggtgatggctaactgtgagcgtaacggtggctccggtgccatcacagtcacgataaatattaacggccaggtgaaaacggcggaggttatgccgtataccgcagggattccggccatgtatcagaccgtcgtcttttcggtctacaccacttcacctgtcgtggatatcagcgtctctctgagggtccgtgggcagtacaccacgtctgcttccgtctggccgctggtgatggtttcccggtcggggagcaacttcacaaactgaccggatttccggtccctttcgtttaatgaggaacaaatatgactatgtcgcgcgtaatttctctggcggcagggctttccctgtccgttttattttccactgctgccgttgccgataacggaagaggaagcggcaacagcaatattgaaaaccagacccggatttataccggcaccgaccgtgggcagaaacagcaccgcgaggcaaagggaaaaacaatcacgcggagcgtccagtgttctctgccggcatatttacgtgacccggataatcagtgctgagatgtgaatgaatctgaagcctgcctgcgggcgggcttttttatggaggcaatatgccagtacttatttccggcgtactgaaggatggtacgggaacgccggtacagaactgcaccattcagctgaaggcctgccggaccagtacgacggtggtcgtgaatacggtggcatcagaaaatccggatgacgccgggcgctacagcatggatgtggagcaggggcagtacactgtcacgctcctggtggacgggtatcccccgtcacatgccggagttattacggtttacgatgattcaaagccgggcaccctgaatgattttctgggggccatgacagaagacgacgtccgcccggaggcgctgcggcgttttgaggcgatggtggaagaagttgcccgccaggcatcggaggcatcgcggaatgccaccgccgcagggcaggcatctgaacaggcgcagacatcagcaggtcaggcatcggaaagcgccacggcagcagtgaatgcagccggagcggcagaagcatcagccacacaggcagcctcatccgcagcatctgcggagagcagcgcaggtacggcgaccacaaaagccggggaggcatcagccagcgcggcgtcggctgacacagccagaacggcggcagccgcatcggcagccgcagcgaaaacatctgaagcgaatgcagatgcctcccgtactgccgccggcgattcagctgctgccgcagccgccagcgcgacggcggcgcagacatcagcagagcgcgccggagcatccgaaaccgccgcgaagacgtcagaaacgcaggcggcttccagtgccggtgatgcaggtgcgtcagccactgcggcggcagcgtcggaaaaggcggcagccgcatcggcagccgcagcgaaaacatctgagacaaatgcagcaacgtcagcaagtacagcagcggccagcgcaacagccgcctcgtcatcagcatcggaggcatccactcacgccgccgcatctgataccagcgcatcactggcggcgcaaagcagtactgctgccggagcagcagccaccagagcagaagatgccgcaaaacgggcagaagatatcgcggacgtgatttccctggaagatgccagcctgacgaaaaaaggtatcgttaagttaagcagcgccacggacagtgacagcgaagcgctggcagccacgccaaaggcggtccatgctgtcatggacgaggtacagaccaaagcgccgctggacagtccggcactgactggtacgccaacagcaccaactccggaaaccgcagctgcaggtattgaaattgccacggcagcgtttgtggctgcgaaagtggcgcagttggttggttctgcgccggaaacgctggacacgctgaaagaactggctgacgcgctgggtaacgatccgaactttgccaccactgtactgaataaactggcgggcaagcagccgctggacgatacactgacggcgctgtcaggaaaaagcgttgacggtcttatcgaatacgttggtttacgggaaaccataaatcacgccgccgatgcattactaaaatcacagaacggtggcgatattccggaaaagccgctgtttgtacaaaatatcggagcgctccctgcatcaggtacggctgttgcagcgaacagactggcatcacgcggcgcgcttccggcactgactggtgcgacaagaggcagcgatagcggcctgataatgggcgaggtctacaacaatggctatccgacgcaatacggaaatattttacgtctgaccggaactggtgatggggaaatcctcattggctggagcgggacaaacggtgcgccagcgcccgcatatattcgcagtcatcgagataccgccgatgctgagtggtccgaatgggcgatgctctacacctcactaaatccgccaccgaattcgtatccagtaggtgcggcgatagcatggccgtctgatgctaccccagccggttacgccctgatgcaggggcaatcgtttgataaatctgcttacccgttactggctatagcgtatccgtccggcattatccctgacatgcggggctggacaataaagggtaagcccatcagtggacgtgctgtactgtcgcaagaaatggacggcaacaaatcgcacagtcacagcgccagagcgcaggatactgacttagggacaaaatctacctcatcctttgattacggcacgaaatcgaccaataccacgggcaatcatactcaccagttcggcggttatatcaattcatactggggagattccaatcacacctcatttcagcctggaggtggtgcatggacacaggccgctggcgaccatgcacatacagtttatatcggaggacatgagcacaccatgtatataggtccacacggacacgtcgttattgtggacgcagacggtaatgcggaaaccacggttaaaaacattgcatttaactacatagtgaggctggcataatgacttttaaaatgagcgaacaggcgcagacaattaaaattttcaatctgcgttcagatactaacgaatttattggtgcaggtgatgcgtatattccgccgcacacaggactaccggcaaactgtactgatatcgcccctcctgatattcccgccagtcatattgctatatttgacgctgaaacccagacatggagtttgcatgaggatcaccgcggcgagatggtttacgacacaacaaccggcaatcaggtttatatctccgctcctggtccgttgcccgaaaatgtcacatcagtttcaccaggtggtgaataccagaaatgggatggtaaggctaaggtctgggtaaaagacgaagcggctgaaaaagcagcgcagcttcgtcaggcggaagaaaccaaaagccgtcttttgcaaatggcatctgaaaaaatcgcgccattgcaggatgcagttgatcttggaatcgcaacagatgatgagaaagcgcggctcgacgaatggaaaaaatatagggtgctggtaaaccggatggatacagccgcccctgactggccggaaagaccagccagccagtaggcgttactgtggtaatgcaggccacctgattgctgtgaaggtggcctcatctgaaacacctgttaagtccagcgatttaagaacattgatataattcatcggcagaatcaaagctgctttattttcatcactgataatccccagcgttaattctatgcgccagtccttaatggcattatctgaatcgttaagtaatttctgccgggtgacttctgcctgccaaaattgaacgccgggcgttgataccggatgatctggtcatcgtggaaagcgaccctgaaaaaatcgacacttagctgtaaaatgacagtcccgccatccggtcatcataacggatttttcttctgcaccttctgaagcccgccatggcaggacgaccatgaatccgccgataaccttattgtgaaattaaggccaggaagagatgatgtctgtcggacagatactatatgtaaatttataaaggttttttgttatgccctttcatattggaagcggatgtcttcccgccatcatcagtaaccgccgcatttatcgtattgcctggtctgataccccccctgaaatgagttcctgggaaaaaatgaaggaatttttttgctcaacgcaccaggctgaagcgctggagtgcatctggacgatttgtcacccgccggccggaacgacgcgggaggatgtggtcagcagatttgaactgctcaggacgctcgcgtatgacggatgggaggaaaacattcattccggcctgcacggggaaaactacttctgtattctggatgaagacagtcaggagatattatcagtcaccctggatgacgtcgggaactataccgtaaattgccaggggtacagtgaaacacatcacttaaccatggcaacagaaccgggagtggaacgcacagatataacttacaacctaaccagtgatattgatgctgcggcctatctggaggaattgaaacagaatccaattataaataataaaataatgaatccggtagggcagtgtgagtcattaatgactcctgtaagcaattttatgaatgaaaaagggttcgataatattcgttatcgaggtatatttatctgggataaaccaacagaggaaataccaacaaatcattttgcagtggttggaaataaagaaggaaaagactatgtgtttgatgtttcagcccatcagtttgaaaatagaggtatgagtaatctgaatggcccattaattctttcagcagatgaatgggtttgtaaatatagaatggcaacaagaaggaaacttatttattatactgattttagtaattcaagtatagcagctaatgcctatgatgcattaccacgagaattagaatcagaatctatggcagggaaagtttttgttacatcaccgagatggtttaatacctttaaaaagcaaaaatattccttaataggtaaaatgtaagcgcaccgtggaggacgtctgtcagaaccctgtcaatccggcgatgatagtgtccacttaaattttgatggacactatcacagatgacagagtccacagcccggcgcaaacacggctgtcggtcaggaaagagaaaagccagtcgctgtacgactggatacaggcgcagttgaaaacattgtcggtgcatgcggagatggcgaaggagttcggttacatgctgaagcagtgtgatgcgttgagcgtgtcctctgctgcgacggtcgggtggagatcgacaacaacatctgtgaaaacgccttacggtgcgtggcgctgggccgacgtaactatctgttcttcggctcagacagtagcggcgaggcagcggcgatcatctatagcctgctgggtacgtgcaaactaaacgacgtggagtccgaggcatggttacgcgacgtgctgtggaaaatcagcgactggtcatcgaaccgggtgcacgaactgctgccctggaacctcgaaaccgtaaaataatccttacgctacgtcctaaacgggacgcttactgagttatgagggtgaggtggttttcttgatgagcatctgaacgccggtttgtgggatagggcaggtgggacggattcgggacagtcatccgtttttaactattggcatggattggtatcttttcgcatcatgggacgtgtgagcgcaggtatgacgcggtatgttattgacttagaatgtggttccaggaactggcgcatccatacccgagcagtttccggtgtcagtgccagcgggcgacgatcgtgaatgtctaccagacctttatcggctgcggaggtaacaatcagaaatccctctgcttcatcaccgcgctcaaacggcgtactgccaatggcagccatgaatatcggcttcccgtcctttctgtgaatgaaatacggctgttttttgtcgccttccttcttccactcgaaccatctatcggcaaaacagatagcccggccatgctgccatagtggcttaaacattctgctggaggccgctgtcgcgacacgggcgttaataagtggagctttatcccaccatccgggagcgtaaccccaaatcaccgggtcgagatgtaattgctcgtcgcgttcgctcaatagcaggactttagtcccgggcgccacgttataccggcctataggctgagggtcataagcaatattacgatcggcttcgtcggccagatatgccagatattcttcacgggtctgtgcttgtgcaaagcgtccacacatatgaaaccgccagtcgtcaggctgaaagtatagggcagggggaaaatgtggcgcgctccggtaatgatttacagggaatttatacagtaattcgaaatgaaaatttgtgtattgatgaattccgaaactgagcagtgagcaaactgatgaatcaatcgcaaattgcgtcgaatctcgacggctttattccccagtttcaccccatagcttccccgtaggaaattgagccataaaaaaaacagccctgacaggctggtttttaaggggaattttggtcggcacgagaggatttgaacctccgcccccccatgttggcggtagcctgaataattatcttggtaaaggttaactatcataaaatggtacaccagtctttccaggaggaggagtgtaaaggttttggctcataaacaccgtcatagtaaagaccacaaatactgcaatcttcatttttatatttatcattgaatgctaaggtaagcttgtcatagacatcaatatttgattgccattcaggtgaggtattcattgaatcataaattaatacttttttcacttcactatcatagcctacaatgcactctgcatgtagacattccgagccaagtgaaggcctgatcaacatcagtggtccatggttttgtaattcgtaagaaataaaactctcaaagtcatcttctacagtactattgaaaacttctgcctgtaaagcttctttaatgtttgtaaaaagagaggattcaggtattttttgcacattcatttcttttaataaattctcacattctattatatcaataccctctaatatattattaaacgcttgattatcagaagtgatgtcctctaatgcactataattattgccatctctggatttgataacatttaatgagcaaacccagcaattattgtagagggtgttgcctgtggtatcaaactggctttgaaagttacgatggtgaataatctgaccctgaggagttgctgtattacttctgtaaacgctgcctaaactattttgaatgtgtcttaacataatatactcgccgaatagtaattttgttaatgtaattatatactacagtgtggatattaatacaattcttttgttgttaattattatttatgaaattaattaaaagtgaataagttagaggtgtttgttggccttaaaattacatttgttgagggggcttatatgatatgtttttattgtattgtcgcatttttcttaagctgaatccggattttggggaggtggctaaatgtaaatgacgtggtttaagataaatctatttttaataagctatctgttcaaattttcgcgatcgcttttgttggtatcactattcaagcagtttgcctgcatcggcttcaccctcacttcggcatcagggaaaatctggtgcacctgcttcgtcagttcggccagaatgatctcgctggccccttcgagtccttcaacattacgcttgtcataaaccagttctacgaacatacgtgtttcgctaataactgtttgtatatacagtatttttgctttggcggttttgtctgtcaaggcatgaaccacttgtttttaaattttggggaacatactgcgggcgtgtttgttatcgattttccctgcagggctgatggggtctggcgttgactaaaattatgtgtggggcatggatggggcaaaagtggtctgtgaagttcgttaaagttcgttaatcaagcttcatctcgatctcgctcatcccttgtttaaagcgctcctggacgatctttatcgattttaaaaactatgagtacatattataaaaatgtagcaaataggccgtttgtgcctgaaaagatgaacattctgcgtagcgcgatttgcgcaacaggaatagactggagtcgacactctacacaaagatgcgaaaggttttttatgacacaacagccacaagccaaataccgccatgactatcgcgcgccggattaccagattactgatattgacttgacctttgacctcgatgccgaaaaaaccgtggtcaccgcaataagccaggctgttcgtcatggcgcgcctgatgcgcctcttcgccttgatggggaagatttaacgctggtatctatccacgtcaacgatgcgccgtggacagcatataaagaagaagagggcgcgcttgtcatcagcgacctgccagagcgttttacgttacgcattgtcaacgagataagtccggcggcgaatacggcgctggaaggattgtaccagtcaggcgatgcgctctgtacccagtgtgaagcggagggcttccgccatattacctggtatcttgaccgcccggacgtactggcgcgatttaccaccaaaattattgccgataaaagcaaatatccgttcctgctctccaatggcaaccgtgttgcacagggcgagctggagaatggccgtcactgggttcagtggcaagatccgttcccgaaaccgtgttatctgtttgcgctggtggccggtgattttgacgtgctgcgcgatacctttaccacccgctccgggcgtgaagtcgcattagaactgtacgttgaccgtggcaatctggatcgtgcgccgtgggcaatgacctcgctgaaaaattccatgaaatgggatgaagcgcgttttgggctcgaatatgacctcgacatctatatgattgtcgcggtggatttctttaatatgggcgcgatggagaataaaggtctcaatatctttaactccaaatacgtgctggcgcgaaccgataccgcgacggataaagattatctcgatattgagcgcgtgataggccatgagtatttccacaactggaccggcaaccgcgtcacctgccgcgactggttccagttgagcctgaaagaggggctaaccgtgttccgcgatcaggagtttagctctgatttggggtcacgcgcggtgaaccgcatcagtaacgtgcgtaccatgcgcggtttacaattcgcggaagacgccagcccgatggcgcatcctatccgcccggataaagtaatcgaaatgaataacttctacaccctcaccgtttatgaaaagggcgcggaagtcattcgcatgatccacacgttgctgggtgaggaaaatttccagaaggggatgcagctttattttgagcgccatgacggcagcgccgcgacgtgtgatgacttcgtacaggcgatggaagatgcttctaatgtcgatttgtcccatttccgccgctggtacagtcagtccggcacgccgattgtaacggtaaaagatgattataatccggaaaccgagcagtacacgttgaccatcagccagcgcactccggcgacggcggatcaggcggagaagcagccgctgcatattccattcgccatcgaactgtacgataacgaaggcaacgtcattccgttgcaaaaaggcggtcacccggtcaacgccgtgctgaacgtcacgcaggcggagcagacatttaccttcgataatgtttacttccagcctgttccggccttgctgtgcgagttttcagcgccggtgaagctggaatataaatggagcgatcagcagttgacgttcctgatgcgccatgcgcgcaatgatttctcccgttgggatgcggcgcaaagcctgctggccacatacattaaactgaatgtggcgcgtcatcagcaggggcaaccgctatcgcttccggtgcatgtcgctgatgcgttccgcgcagtactgttggatgagaaaatcgatccggcgttggccgcagaaattttaacgctgccttcggccaatgaaattgcggagctgtttgaggtcattgacccgatcgccattgcgcaagttcgtgaagcgctaacgcgtacgctggcggcagaactggcggatgagttcctggctatctataacgccaatcatctggatgagtatcgtgttgatcacggcgatatcggtaagcgcacgctgcgcaatgcttgcctgcgcttcctggcgtttggcgagacggagctggctaatacgctggtcagcaaacagtatcgcgacgccaataatatgaccgatgcgctggcggccctgtctgctgctgtggcggcgcagttgccgtgccgcgatacgctgatgcaggagtatgacgataagtggcatcaggacggcctggtgatggataaatggtttatcctgcaatccacaagcccggcggaaaatgtactggaaaccgtacgcggcctgctcaaacaccgttctttcagtatgagcaacccgaaccgcatccgttcattaattggcgcgtttgctggcagcaacccggcggcgttccatgcgcaagacggtagcggataccagttcctggtcgagatgctgaccgatctgaatagccgtaacccgcaggtagcatctcgcctcattgaaccgctgattcgtctgaaacgttatgatgataagcgtcaggagaaaatgcgtgcggcgctggagcagttaaaaggactggagaatctttccggcgatctgtacgagaagataactaaagcgttagcctgacagtatccgttataaagaggtaagacatgcccggtaagcgttagcgctgccgggcatttttttgccggacgatgacgcttcctggcgaaacgtgaagtgagaatgaaggaaaacgattgctatttattgccgtaggtcaattcccttttgccttgttatcgcccataatacgcccccggtttgcacaccgggaatccaggagagttcatgtactatcccttcgttcgtaaagcccttttccagctcgatccagagcgcgctcatgaatttacatttcaacaattacgccgcattacaggtacgccgctggaagcgctggtgcgccagaaagtaccgacaaagccggttacctgcatgggacttacctttaaaaatccactggggctggctgccggtctggataaagacggggagtgcatcgacgcgttaggcgcgatggggtttggctccctggaaatcggcaccgtgacgccgcgcccacagccgggtaacgataagccgcgtctttttcgtctggtggatgctgaaggtctgatcaatcggatgggctttaataatctgggcgtcgataacctggtcgagaatgttaaaaaagcccattttgatggtattctgggaattaacatcggtaaaaataaagatacgcctgtcgaaaatggcaaagatgactacctgatttgtatggaaaaagtctatgcttatgcgggttatatcgccattaatatttcttcgccgaatacgccagggctacgtacgctccagtatggcgatgcgctggacgatctgttaactgccattaaaaataagcaaaacgatcttcaggcgatccaccataaatatgtgccggtggcagtaaagatcgcgccggatctttgtgaagaagaattgatccaggttgccgatagcctgcttcgtcataatattgatggggtgattgcgacaaataccaccctcgatcgttctctggtacaaggaatgaaaaattgccagcaaacggggggattaagtggccggccattacaattaaaaagcacagaaattattcgccgtttatcccaggagttaaagggacaattgcctattatcggcgtcggcggcattgactcagttatcgccgcgcgcgagaagatagcggcaggagctacgctggtacaaatttattccggctttatttttaaaggcccgccattgattaaagaaatcgtaacgcacatctaaactttaccctttatcagacaaccagggctttatttccggcgctggttgttttatatttctccactgttgcttatttagacattttaggcttttattattggggtaataaacgaagcggcaaaaggacaatgctgttacgagttgcttaaaagcgggagagaggtaatgcgaattaaacctgacgataactggcgctggtattatgatgaagagcacgatcgtatgatgctcgatctcgccaatggtatgctttttcgctcgcgcttctctcgtaaaatgcttacgccggacgcgttttgcccgaccggtttttgtgtggatgatgccgcgctctatttttcctttgaagaaaaatgccgggatttcgaattaaccaaagagcaacgcgcggagctggtattgaatgcgctggtggcgattcgctatctcaaaccgcagatgccgaaaagctggcattttgtagcgcatggcgaaatgtggaccccgggaacgggcgatgccgcaagcgtctggttaagcgatacggcggaacaggttaatttgctggtcgttgagccgggagaaaatgccgcgttgtgtctgctggcacagccgggcgtggtgatagcaggccgaaccatgcagcttggcgatgcgattaaaattatgaacgacaggctgaaaccgcaggttcactgtcacagtttcagccttgaacaagcggtttaattttccagtcgtaacgcggtcttaggcacgcagctacagctcagaatcgtaccatcgtcacccatagccgattttttcagcggacttacttcgccttccagcaaacgtatccggcagcaaccacagataccagcccggcaagaatacggaatacgaatcccctgattctccaactgttccagtagtacctgttgattattcccgcagaaggtttgcccctgccagtcgatggttacactcgcgtccgggtgtttctctggcgtaacgctgttgtcgaccgttgtggcgccataagcttttgccggggctgtcgccagaatctccacctcatcgccgacgcgaatgacgccgctattgcgggcaatcagattctgaccgaaatccacatcgccattgtccagggcggtacgaaaagcttgcagtgtcgccagcggttctccggaaggatgtttttgccccttttcagggctgacggtcgtaaaaatacagcggctacagggcttcacgacgtcaaaaatcacatcgccaatgcgaagcactttccagctatcttcctcccaggccgctacgccggaaaccactaagtttgggcgaaattgttccatttgtacgcctgccggacaacgctgttgcagatcgcgcagcgaggcttcgttggtcaataaatacgggtagccatcggcaaatcccagcggcaccgcgttatgtcgtttgacccggcgtgtcaactgcggcccaacccagcgcaactggacatcgcgggagaaaaagccgctcaaccattgattaatcgccgtcggggcgacgcgagcggtaaaatggtttccccagacctcggtcggcgcatcctgcggggtgaaatccgtaaagcgaaccagcgcgctactgccgtctggcgcggtcaaatgaaggccgtcgtgtaagggagagggggtaaaacgtaccatttgtggaaactggcgggcggtaataaatgtgccgtcaggctcggtcaccatgaagatgcgatcaaaagccaggccgctgatatctgccagcgcatgagtcaggccaatgccgcgcatggatttgaccggatgaataaagagccgtgataacgtcgccaccgtacagtccctcaaatgaaaataagccttcaactttatgacatgggcgtgagattagctataatgcgcaacaattttcttagcgtaaaagtgacaatatgaattctctgtttgccagtacggcccgcgggctggaagagctgttaaaaactgaactggaaaaactgggcgccgtagggtgtcaggttgttcagggtggggtccattttcagggcgacacgcggcttatttaccagagcctgatgtggagccgcctggcctcgcgtattatcctgccgatgggtgagtgcaaggtctacagcgatctcgatctttacctcggcgttcaggcgataaactggacagagatttttaatcctggcgcgacgtttgcggtgcatttcagcggcctgaacgacaccatccgtaatagtcagtatggcgcgatgaaagttaaagacgcgattgtcgatgcgtttacgcggaaaaatcttccgcgtccaaatgtggaccgcgaatcgccggacctccgtattaacgtctggctgaataaagaaactgccagcattgcgctggatctcagtggtgatggcctgcacctgcgcggttatcgcgatcgcaccgggctggcgccaattaaagagacgctggcggcagcgattgttatgcgttccggctggcaaccaggtacgccgctgctcgaccctatgtgtggttcggggacactgttgattgaggccgcgatgtgggcgaccgatcgcgcgccgggcctgcaccgtggtcactggggatttagcggctgggcacagcatgacgaaactatctggcaggaagtgaaagccgaagcgcagacccgggcgcgtaaggggctggcggagtattcctctcatttctacggttccgacagcgatgcgcgcgtcattgagcgggcgcgcagcaacgcccgtcgcgccggtatcggcgagcttatcacctttgaagtgaaagatgtggcgcaactgagtaatccattgccgaaaggcccgtatggtacggtgatcagtaacccgccttacggcgaacgtctggacagcgaaccggcgctgattgcgttgcacagcctgctgggccgtaccatgaaaaatcagtttggcggctggaacctgtcgctgttcagcgcttcgcccgatctgctgggcagcctgcaattacgtgccgacaaacagtttaaagccaagaatggcccgctggactgcgtgcagaaaaactatcatattgcggaaaccacggcggacagtaaaccggcgacggtggcggaagattacgctaatcgcctgcgtaaaaatcttaaaaagctggagaaatgggcgcgccaggaagggattgaatgctatcgcttgtatgatgccgacctgccggaatataacgtggcggtagaccgttacggcgactgggcggtgattcaggaatatgcgccgccgaaaacggtggatgcgcaaaaagcgcggcaacgtctgttcgatattattgcggcaaccttgtcagtgctcggtattccgccgaataaactggtgttaaaaacccgtgaacggcaaaaaggaaaaaaccagtatcagaaaatgagcgagaagggcgagttccttgaggtcagcgaatataatgcgcgcttatgggtaaatctgacggattatctcgacaccggtctgttcctcgatcaccgtattgcccgcagaatgctgggagaaatgagcaaaggcaaagatttcctgaatctcttttcttataccggcagcgccagcgtacatgcgggtctgggcggcgcgcgcagcaccacaacggtggatatgtcccgcacctatctggagtgggccgaacgtaatttgcgtctgaacggactgagcggccgcgcgcatcgcctgattcaggccgactgcctgggctggctgcgcgaggcgaatgaacagttcgatttgatctttatcgatccgccgacgttctctaactcaaaacgtatggaagagtcgtttgatgttcagcgcgatcatgtcgcgttaatgaaagatttaaaacgcctgctgcgtaaaggcggcaccatcatgttctcaaataataagcgcggattccgtatggatctggaagggctggcggaactggggcttaccgcacaagaaattacgcaaaaaacgctctccccggattttgcccgtaaccgtcagattcataactgctggctgatccgcgccgcctgaaaggaaaagtaaatgtcattaatcagtatgcatggcgcatggctgtcgttcagcgacgcgccgcttctcgataacgcagagttgcatatcgaagataacgaacgcgtctgtctggtggggcgtaacggcgccgggaaatccaccttgatgaagatcctcaaccgcgaacagggtctggacgatgggcgtattatttatgagcaggatctgatcgtcgcgcgtctgcaacaggacccgccccgtaatattgcgggcagcgtctatgactttgtcgccgaaggtatcgaagaacaagcggaatacctcaagcgctatcatgagatttcccgtctggtgatgaccgatcccagcgagaaaaacctcaatgaaatggcgcgcgtacaggaacagctcgatcatcataatctgtggcagctggaaaaccgtattaatgaagtgctggcgcagcttggactcgatcctaacgccgcgctgtcgtcgctctccggcggctggttgcgtaaagccgcgctgggtcgggcgctggtcagcaatccgcgcgtattgttactggatgaaccgactaaccatctggatatcgaaactatcgactggctggaagggtttctgaaaacctttaacggaacgattatttttatctctcacgatcgttcgtttattcgcaatatggcaacccgcattgtcgatctcgatcgtggcaaactggtcacctatccgggaaattacgatcaatacctgctggagaaagaagaagcgctgcgcgtagaagaattacaaaacgcggaatttgatcgcaaactggcgcaggaagaagtctggattcgccagggtatcaaggcgcgccgcacccgtaatgaagggcgcgtgcgggcgttaaaagcgatgcgtcgtgaacgcagcgagcgccgggaagtgatgggcacggcgaagatgcaggtcgaagaggcgacgcgctccggtaaaatcgtttttgagatggaaaacgtcgattaccaggtagaaggaaaacaactggtaaaagatttctccgctcaggtacagcgcggcgacaagattgcgttaattggcccgaacggctgcggtaaaaccacgctactgaaactgatgctgggacagcttcaggctgacagcgggcgcatccacgtaggaacgaagctggaagtcgcctacttcgatcagcatcgcgccgaactggatccggaaaaaaccgtgatggataaccttgcggaaggcaagcaagaggtgatggtaaacggtaagccgcgccatgtactgggctatttgcaggacttcctgtttcaccccaaacgggcgatgacacccgtccgtgcgctttccggcggcgaacgtaaccgtctgctgctggcacgactgttcctcaagccgagcaatcttttaattctcgatgaaccaacgaacgatcttgacgtcgaaacgctggaactattagaagaattaattgatggctatcagggcacggtactactggtcagccacgatcggcaatttgtcgataataccgtgacggaatgctggattttcgagggcggcggcaaaatcggacgttatatcggcggctaccatgatgcgcgtgcgcagcaagagcagcatctggcgacgaaacagccgatggcgaaaaaaaatgaggaagttattgcccctaaagcagaaattgtaaaacgtggcagtagcaaactaagctataaactgcagcgcgagctggagcagttacccggtcagcttgaagacctggaagcgaagctggaagcgctacaggcgcaggttgcggatgcggccttttttagccaaccccatgagcaaacgcaaaaagttctggccgatttaagtcaggcggagcaagaacttgagcaagccttcgaacgttgggagtatcttgaaggcctgaaaaacggggcataacgaaaggagcgcctatgtgtgaacatcaccatgctgcgaagcacatattgtgcccgcaatgtgacatgctggtggctttaccccgcctctcgcatgggcaaaaagcagcatgtccacgatgcggcgcaacgttaacgaccgagtgggacgcgccccggcagcgtcctaccgcctatgcgttagcggcactatttatgttgctgctttctaacctttttcccttcgtgaatatgaatgtcgcgggcgtcaccagcgaagtcacgcttctggaaatccccggcgtcatgttttctgaagattacgccagcctcggcacgttctttttattatttgtccaactggtgccggcattttgcctggtgaccattctattacttgtcaaccgcgccagtctgccgttgtcggtaaaaaaaacgctggcaaggatctttttcctcctcaaatcgtggggaatggcagaaatatttctcgccggggtgttggtcagttttgttaagctgatggcttacggcgatatcggcatcggcagcagctttattccctggtgcttattttgtctcgttcaactgcgggcgttccagtgtgtcgatcgccgctggttgtgggatgatatcgccccgcagcctgcactggcgcagccgttaacgccggggattaccggtatccggcagtctttgcgttcttgcgcctgctgtacggcgatcctgcctgcggagagtctcgtctgtccgcgttgccatacgaaaggctatgtccggcgtaaaaacagtttgcagtggacgctggcgttattatttacctcgatcatgctttatctgcccgccaatattttgccgattatgattaccgacttactgggctcgaaaatgccgtcgaccattctggctggcgtgattttgctgtggagcgaggggtcttatccggtggcggcggttatctttctcgccagtattatggtgccgacgctaaaaatgatcgccattgcctggctttgttgggatgcgaaaggccacggtaagcgcgacagtgaacggatgcattttatttatgaagtagtggagtttgtggggcgctggtcaatgattgatgtctttgtcattgccgtactctctgcgctggtgcgtatgggagggttaatgaatatttatcctgcgatgggtgcgttgatgtttgctttagtcgtcataatgacaatgttttctgcgatgacctttgatccgcgtctgtcgtgggatcgtgagtacgaaccaggccatgaggagtcctgatagcatggaacctaaaaaaggggaagccaaagtacaaaaggtgaaaaattggtcgcctgtctggatattcccgattgttactgcgcttatcggagcctggattctgttttatcactacagccaccagggaccggaagttaccttaatcaccaccaatgcggaaggcattgaaggcggaaaaacgacgatcaaaagtcgcagcgtggatgtcggcgtggttgaaagcgcgacgctgactgacgatctgacccacgtacaaatcaaagcgcggctccattccggtatggaaaagttgctgcataaagactcggtattttgggtggtaaaaccgcaggtggggcgtgaaggcatcagcgggcttgggacgctgctatcaggcgcgtatattgaactacaaccaggaagtaagggcagtcagccggaaagctatcagcttcttgactcaccgccgttggcgccgcccgatgccaaaggtattcgtgtgattctggacagcaaaaaggccggtcagctcagtcctggcgatcccgttctgttccggggttatcgggtaggatccgttgaaaccagctctttcgatccgcaaaaacggacaatgagttatcagttgttcattaaggcgccaaacgatcgattggtcaccagtaatgtccgattctggaaagatagcggtatcgctgtggatctgacatcggcgggaatgcgcgtggaaatgggatcgttgacgacgttgtttggcggcggcgtgagttttgatgtgccggaaggacttgagcaggggcaacccgtcgccgaaaaaacggcgtttaatctctacgacgatcaaaaaagtattcaggattcgctgtacaccgatcatatcgattacctgatgttctttaaagattcggtgcgcggattacaacccggcgcgccgctggagttccgcggtattcgtctggggacggtaagcaaagtgcctttctttgcgtctaaaatgcgccaggtatttaacgacgattaccgtattcctgtgctggtgcgcattgaaccggagcgtctgaaagcgcaattgggagaaaatgcggatgttggcgcgcatttgacggaactgcttaagcgcggtttacgcgcttcgcttaaaaccggtaacctggtgaccggggcgctgtatgtcgatctggacttttatcctaaggagccgccgattaccgggctacgcgaatttgatggttatgaaattattcccaccgtcagcagcggtctggcgcaaattcaacagcgactggtggaaacgttggataagatcaacaacctgccgttgaatccgatgattgaacaagcgaccaatacgctgtctgaaagccagcgtactatgcgtcggctgcaaaccacgctggataatatgaacaagattacctccagtcagtcgatgcagcagcttccggcggatatgcaaacgacgttacgcgaacttaaccgcagtatgcaaggcttccagcctggatcggcggcgtataacaaaatggtggcggatatgcagcgtctcgatcaggtgcttcgtgagttacaaccggtgttgaaaactctgaacgagaagagcaacgcgctggtatttgaagcgaaggataaaaaagatcctgagcctaagagggcgaaacaatgaaaaaatggctagtcgtgataatggcgttctggctggcgtcatgtagctccggcggagagaataaaagctattatcagctcccgatagcgcaaagcggtgtgcaaagcaccgcaagccagggcaaccgtctcttatgggtagagcaggtttccgtacctgactatctggcaggtaacggcgtggtgtatcaaaccagtgatgttcagtatgtgattgccaataacaatctgtgggccagcccgctggaccagcaattacgtaacacgctggtggcgaatcttagcgcccggcttcctggctgggtcgtcgcttcccagccgttgggaaccacccaggatacgttaaacgttaccgtaaccggattccatggacgctacgatggtaaggttatcgtcagcggggagtggttattaaaccacaatggacagctgattaagcggcctttccatatcgaagccagtcagcagaaagatggctatgatgagatggtcaaagtactggcaagcgcatggagtcaggaagcagccgctatcgcagatgagataaagcgccttccctgagataaaagtaatgtaaatttaaccgcttcaggtcgtgcgcctgaggcggtttttttatttttgacgccggaaaaatagttgttatggctcacattttttgtacaaatgatttaccgtatagctcacaaatatgacattggtgtgaattttgcgcattgacgggcgatccatttagaggtattcgtgtagtgtgattgcacattttgtaatcactgttttcttttccaccagatacaaatatgagggaaacgaggcatgaagagacaaaaacgagatcgcctggaacgggcacatcaacgtggatatcaggccggcatcgccggacgatcaaaagaaatgtgtccctatcagacgctgaatcaacggtcatactggttgggaggttggcgacaagccatggaggacagggcggtaatggcctgattctgtctctttagaaaaagaaacctccgcagtgcggaggtttcgcctttatgggctttgcaagcatgataccgatagcgcggaatatcaattcaacacttagaacgcggaagtatcctggaacaaaccgactttcaaatcgtgtgcggtatagatcaggcgaccatccaccagaacctcaccgtccgccaggcccatgatcaggcgacggtttacgatacgtttgaaatgaatacgataggtgactttcctggctgtcggcagaacctggccggtaaatttcacttcgcccacgcccagagcgcggcctttgccttcgccgcccaaccagcccaggtagaatcccaccaattgccacatagcatccagacccagacaaccgggcatcaccggatcgccgataaagtggcatccgaagaaccatagatccggattgatatccagctcggcttcgacatagcctttgtcgaaattgccgcccgtttcggtcatcttaacgacgcggtccatcatcagcatgttcggtgcagggagttgcggccctttagcgccaaacagttcaccacgaccagaggcaagaaggtcttcttttgtataggattcgcgtttatctaccatgttttatgtaaaccttattttattgaagcacgcaggatagctaacacgtgtacgctgaacaagtccgatcagttcggaataaaagcgttcagccaacgtaatggccacgggaaacgatgacggccttcctgttgcgtcgcctgcgcgatacgctcctggatagtctgcatcaacgtcgtttgaccttcgccatcccacaccagatttaacagtagcggtaaggcgtcggtcacgtcgtctaccgcccagatagtgaacttctcttctttaaccgcttgcagcagttcagatttaagactgagatggcggacattggcggcagggataatcacgccctgtttaccgtttaattcccgctgctcgcagatggcgaagaaaccttcaattttttcgtttagcccgcccaccggttgcgcgcgaccaaactgatcgaccgagccggtaatcgcaatattttgattcactggcacattggccagtgcgctgatgagcgcacataattccgccattgaggcgctatcgccatccacttcgctgtaggactgctcaaaggttaacgaggcagagaagggaatttgttgctccagctgcaactccgacatcaggaaggcctgcataatcatcattcccttagcgtggatatttccgccaagttcggccttgcgctcaatatcattaaattcgccatcgccgatatgcacaacacagctaattcgcgacggttcgccaaaggcgcgaggatgcccgggaaactcaatgacggaaagcgcattgatttgtccaacgcgttcgccttcggtttcaatcaggatctgctcttgcagaatctcatcctgcatccgttccgccagaaagccttctcgccattcgcgtcgggcaagcatcagactgagcgcttctgcgccgcaggtatcgccttcgcataaaggcgatgcctccttaaactggcgggctatccacagtgggcaaagaggcagcgtatcctgttcgccggtatagcgcacagcctcgcgtatcagaacgggccaggcatccggtgccgggggcggcaaattatcgcgtaaagcgatacgcgtcacccattgacaccacagggtcatagcttctgcgtccgctatctgtaaattgtcttcaaattcactgtagatagcctgttccgcgagctccggttccatctcctgaaaatcagccagtgattcacgttcgccaaccagaatcaccttcagtttgagcggcattgatggcacggagaccggtaatggacgcgactcgtcaaaggccacccagtcaaaacgctcgcggctaacgatggctttcagacgcatccatagtaacggctgcgccagaagggttcgtaaggaaataatcagcacgccgccgtttgcctgatgaaccagtcccggctgcagggtaatgtcgccgttatactgccgcaggcaaccaaagagctgttcggcttcgacccagtccgcgctgacgacttgtgtgacggtggcaaagttgtcttgcgcattctgcgcggcgcggtaatgaacagtatgcccggaaacgtcataatgtccgccggttaattgtccggcatcggtttgcagagcgcggacggcatctgaaagtaaagtgagatactcttgctcttcaggcgctttagtcagcataaaagaggatgatgcccacggctgtataagttgctcaagcgcaaattgcagtcgtggctgagtatcactgagtaaggtgtcgttttcgtcagtcgcgtgtggctgtgcaaatatctcctgatagctttcgctatccggaaccagatcacgccatgcaagtttcgtaatggtcaaagttgaggttttttagtctgttgtaaaaggggggattatagcctaacccgtcacgctgcacacgcggaaagcgaatgcaaagtaatatgaagacgtgtaaccattcacaggttcgagattcttttcttcagatggctaaaaaactgatattctgataacagttacacggtaacattgggatcacaatgaaatatcaacaacttgaaaatcttgaaagcggttggaaatggaaatatctggtgaaaaagcaccgcgaaggggagctgatcacccgctacgtggaagccagtgctgcccaggaagccgtcaatttgttgttggccctcgaaaatgaaccggtgcgggtaaatgtctggatagacaggcatatgaatcctgccttgcttaatcggatgaaacaaaccattcgggcaagacgcaaacgacacttcaatgcggaacatcagcatacgcgcaaaaaatctatcgatttagagtttatggtctggcagcgtctggcgggccttgcgcagcgacgcggtaaaacattatccgaaacgattgtgcaactgatagaagacgcggagcataaagagaaatatgccacgcaaatgaccacgttaaagcaggatttacaggcgttattaggcaagaagtaacgctgaaaggcgttgtcatccagaccagagcaaaaaaccccgcgacgcggggttttttatcagacggaaacttaagcctgcggctgagttaccacgtctttaacgcctttaacttcgatctctacgcgacgatccggagccaggcaatcgatcagggcagcgcgaggtttcacgttgtcacaggtgttgccggtaaccgggttagattcgcccataccacgtgcggagattttgtcagacggaatacctttggagatcaggtaatcaacaacagactgagcacgtttctcggacagaccctggttgtaagcgtcagaaccgatacggtcagtgaagcccagaacgacaacggaaccgtctttcggatccaggttgctcagctggctgtacagctgatccagagcctgctggccttccggcttcagggtagatttgttgaagttgaacagtacgtcagacttcagagtgaagtgcttggtctgtacttccggagccggagctggtgccggagctactaccggagcagcttcttgctggccgaaacggtaggaaacacctacgctcagcaggccgttgtccggacgggtgccgatggtgttggcatcaccgatgttgttagtccactggtattccagacgggttgcgatttcaggggtgatagcatactcgataccgcccgcgaataccggggaaacgccggtgtcgtggtctttagtagacgggccgccagggacgttagacttggtgtctgcacgccataccataccacccagacgggtataaacgtccagatcgtcagtgattggataacccagtttagcggtcaactgaacgccctgagctttataagcgccattgatgttgtcgcctttgtacggcatacggcctaaccagtcgtagcccatttcaaagccaacatacgggttaacctggtaaccaccaaaagcacctgcgcccagttggttttcatgagtcgggccatcattgtgaatgaagccggtgtcatggtactgagaccagcccagtttagcaccagcgtaccaggtgttatctttcggagcggcctgcgctacggtagcgaaaccagccagtgccactgcaatcgcgatagctgtctttttcattttttgcgcctcgttatcatccaaaatacgccatgaatatctccaacgagataacacggttaaatccttcaccgggggatctgctcaatagttactctaccgatatctacggcttatgctgagcacccctggcgatgtaaagtctacaacgtagttggaaacttacaagtgtgaactccgtcagacatgtgaaaaaaacatgacggatatacacatcatttaacagtttcagatgataaatcgtacagcaaaaattgcggaaaccgcttctgacaagcgttctcgcaaaaaaaacgttagcactcaaaggagatacgttcgcgtaaaaaaaagtccaggataaatcctaattttacttaatgatacaaattagagtgaatttttagcccggaatgctgtctcctgggtaaagcgtgcgcacgtacagggcgcatgataaaccctaccgcattacctaccttcgctgcttcaaccaggctggcatgttcttcttctgtcagttcttcagtcatccaaccaattaccacgctgtaatttcctgtacgcaaagcgcggatcatcgactccagcgtatgacgaggcgcaagctggctaatttgcatcactttcgttaatggcaaacctgaagactgtacccattcacggctgagcttttgctgcggcgtgagccagagctgccatcgtgattgttggcctaactgacggagtaaaggcaaaagcaggagttgcgccatcatgggctggtcttcgtggtagacaacttcactgaccagtcctgccgcggcattttccgtagcggtgcgcgcagcgttgtgggtagtggtaggaaatgacgaagaacgatttgcataacctgaagtgtacataatcaatccagccctgtgagttactgtatattcatacagtacccctgtggcgatgaaagatcaactctattttcggaaactgtctcgcaatttttattcttagtggcgtcaaaaataaaaatcatcttgctcgcggagtataagttgcctattttcgtcattaacggatccgttactgcaaattattcttttactttatgatttaaaaggaattttatgagagcactctcttatgacaggatctataaatcgcaagaatatttggcctctttggggacgatccagtatcgatctttattcggtagctatagtctgaccgtggaggataccgtctttgcgatggtggctaatggcgagctttatctccgcgcctgtgaagaaagcgtaccctactgtgtgaagcatcctcccgcctggctcatgtttatgaaatgtggacgtcccgttatgctcaactattaccgggtggatgaaagcctgtggcgcgatcagcagcagctggtgcgtttatcgaagtattctcttgacgcggcaatgaaggaaaaacacagccgtattttacagcacagactcaaagatctccccaatatgaccttccatctggaaacattgctcaatgagtcagggataaaggacgaaaatatgttacgcatactgggcgcgaaaatgtgctggctaaggttgcgacaaagcaatcccttgctgacggtgaaagttttgtatgccctggaaggcgcaattgtcggcgtacatgaagcggcgctcccggcgagtcgtcgccaggagcttgccgactgggctcattcgcttacggctgggtaattaatgtagaaatcggcggtgaaatttgccgttgcaagcgtccaatctcgggcagtaaggcaatgagcaaaccaatttgttgaacaaccagaggttctttgctgtccggacgtgtttccagtgactgaactcgctgctttaaaccctccagcgcctggtgtacgcgctgttcgtcttcaggttgatgatgaagcgcatcatcaacgtagcagaccgcgtcatccagaagccccaacacgtccggattactgagcttttcgcggtgcgcgccgagggcggagatatagctggtaaaagtgtgattgaggcaaagcagcctgaacgccgcctcccgggtttcagccgtgacgtcgggttcgctcgacatattagaaaccacggatgccagttctgcatcgcggttgtgcgcgtcgcgtctggcaatgcgataggccaggcggttatcccgtccctggtgatattgctcaaggatcgcatcaaggtagcggcaattagcatcggtggcgcgctggagtacccggggaaggttgcgaaagcgccagtccggccaaataaagctgaccgcagcccaggcgatagcgcagccaattaacgtgtcgacgacgcgcggtaacgctacctcgaagccttcgcccaggaggttaaagcagagtaataccagcagggtgatgaacatcgtcgcatgggcatactgcacattacggaatgcgaagaaaagcacgccggtaatcaccagcagaactaactgtccttcaagcgaaggaacaaaccataaaatcggcaggccgatagcaacgcctaccaacgtgccgataatcctgagcgcaaggcgatggcgggtcgcgttatagttaggctggcaaacgaacaggctggtgagcaatatccagtacccgtggcgcatcccggtaatttggatgagagcataaccgatgcacaataccagcgacatgcgtaccgcatggcgaaagagagcggactccggggtaaaattacggctcagacgcagccagatgtcgctaaacccgtgcaggctatcatcagccaactggttttctgactcattgcgcggcattgcctgggcctgctccgactcgatcgtcgctagttgcgcatcaatagcgcgtaggttggttaataagaatccaagcgtattcagcagctctaaagaagcgccgctggcgcgcatacgttcaagcgcggcgtcaatgtgggtaaagacgcgttcaaagcgcggatcatgctggtacggcgtacgcagtaagatacagcgcgccagctgcgtacaggcctgcgcctgcatcgacatcagacgctgaaagcggaacatgacgtcgctatggcgaaaataatcgcgcagcgtctggtattgaatatgcgaagaactggcgcgttcatgaatatcctgcgccacaaaatagtaatggagggtgcggcgcgtaccgcgttgaccgcgatcgccgcgcaggcgagtcaacaacgacactttcgtttggttcagcgtcgccattaactgcccgttcgctaacgctaaatcatagagcggcgcctggctttcatcttcaatatcaggatcaaacagacgtgatttcagttccagatagtgcgctaactgttcgtaactgcgtgccagattatcctgcaacggacggatcggaaatagcagatgcccggttagcgtcagtaggttataccatactgcgcctgccagcaggagcagtggttgctgataccagtgatcgtataaagaggtacccagcatcgtatagatggcaatgagtaacgcgccgaacgcgatggtggcatagcgttgccccagtcctcccaacagaataaacccgctggtggataacgttaagcccaacgcaaatagccacggccagggaaagagcagctccacagaagccgacgcgataaaaaagcaaattaaggtaatgattaaattacgcaagcgtccggcaaggcgatcgtcgagatcggttagcgccgcggcaaccataccgagcgtgagcgggatggtaagtttgacgtcgcccagccaccagggcagggcggtggtgccgcacagagcgataaaaatgcggatgtaatacagccaggtactgttccaggtataacggcgaatcaacggacttaacataaaggctatttgtcccgatcattcaaaacggcggcgcgcgttagcttctcgcgcggcgcgagcggtttctacagagacgacgcggcgaccgacaggccaaagcgcaatcgcggcaattttaaagttcgcaataccgacaggtatcccgatgatagtgacacactgcgcgataccggaggcaatgtgcatcaggcatagccaccagccgaaaaaaagtaaccagaaaatattcagcaaggtaccgccagtattcattaatacgctttttgccgccggattaagttcgtcaacgtgaatggcttcattaccgtaagggaacagggacagtttggttatctcccagcaggagcgggtcaacggcagggtaaaaataagcacaatactgaccagcgtcgccagcagccaggccagcgtagtggcaaagccgcccagtacaaagtttaaaatattcagaacggtacgcataaaccctcagttcattccggttttctatcactgcgggcaattgtaacgtttttttagactggagcacgttttctctggcggttacactgataagcacatctttacgtctggattcgctgagtcatggaactgaaagcaacttctcttggaaaacgtctggcgcaacacccgtatgatcgtgccgagatcctcaacgctggggtgaaagtgtctggcgacaggcatgaatatcttattccattcaatcagttattggcgattcactgtaagcgtgggctggtatggggcgagctggagtttgtcctgccggaggataaagtcgtgcgtttgcacggtaccgagtggtcggaaacccagcaattccatcgctatctggacgcgcactggcgtcgctggagccaggagatgagtgatgtcgccgcgcaggcattacaggagcaatgggcgcgtattagtgagcgaacgggcggaaaccaatggcttacccgtgaacgcgttcgggggctggaacacgaaattcgccagacgtttgccgccttgccgctgccggtctcacgtctggaggagtttgctcactgtcgcgagatatggcgtaagtgtctggcatggttacaggatagcgagggtagtcggcagcagcataatcaggcgtatgctgatgccatgctggaagcgcatgccgacttttttacgcagatagaatcctctccgcttaatccttcccaggccagggcggtggttaacggcgaatcatcgttactggtactggcgggcgcgggaagcggtaagacctcggtgctggtggcgcgcgcgggttggctgttggcgcgcggacaagccgatgcggggcaaattcttttactggcgtttggtcgcaaggcggcagaagagatggatgagcgtatccgcgagcgcttacatacggaagagattactgcccgtacgttccattcgctggcgctgtatattattcagcaaggcagtaaaaaagcgccggttgtcagtaagctggaaagtgacgccaccgcgcggcatcagctatttctgcgcacctggcgtcagcagtgtagcgagaaaaaagcgcaggccaaaggctggcgtcagtggctggaagaggagatgcagtgggtagtgccggaaggtaatttctgggacgatgagacattgcagcggcgtctggcccctcgcctggatcgttgggtcagtttgatgcgtatgcacggcggcgcgcaggcagaaatgatcgctggcgcgccagaggagtgccgcgagctgtttggcaaacgcattaagctgatggcgccgctgctaaaggcctggaaaagcgcgttgaaagcggaaaatgccgttgatttctccgggctgatccatcaggcaatggtgatcctcgaaaaagggcgttttatcagcccgtggaagcatattctggtcgatgaatttcaggatatttccccgcagcgggcggcgctgttagaggcgctgcgcaagcagaatagccagactacgctgtttgccgttggcgatgactggcaggcgatttaccgttttagcggggcgcagctctccttaacgacggcgtttcatcagacgttcggcgagggcgagcattgccacctggacaccacgtaccgctttaacagtcggattggcgatattgccaatcgctttgtacagcagaatccgcaccagcttaaaaaaccgttaaatagtctgaccccaggcgataaaaaagcggtgacgttattggatgaaagccagttggacgcgttactggataaattatccggctatgcgaaggaagatgaacgtatcctggtgctggcgcgctatcaccatctgaaacccgcgagtctacaaaaagcggcgactcgctggccgaagttacagatagacttcatgactatccatgccagcaaaggccaacaggccgattacgtgattcttgtcggattgcaggagggtaacgacggtttccccgccccggcgcgagaatccattatggaaagtgcgcttcttcctcaggttgaggattttccggacgctgaagagcggcgtttgttatatgtggcgttgacgcgcgcgcgtgcgcgggtctggctgctttttaataaagataatccctcgcgctttgtggaggcgcttaaacagctggatgtgccggtggcgaggaagccctaaagcgcgggcggtacagcatcccgcccgcgtagcgtttatttcaggcgctcggccagataacgcgcataatccggaataagaatatctacagcgtcattaaaatgcggggactggatgataaagtccgccgttgagacgttagtggcgacagggatattccatacggtggccagacgcagtagcgctttgacatcggggtcgtgcggtaccgcgttaagcgggtcccagaagaaaatcaacacgtcgattttcccttctgaaatgagtgcgccaacctgctggtcgccgcccatcgggccgctcagcatcgcattaacgtccataccggttgcgcgctggatcagattccccgtggtgccggttgcataaagaacgtgtttttccagcaacggctgatggcgttccacccagttcattaacatctgtttgcagtggtcgtgagcaaccaacgcgatatgtttgcgcgtcggcaaggtgcgagtcgtcagttccataattcgattccgtagttaacctgtctacagattactggaagcgcttgatgctgcaagagaaagagaaaaaaattgcgcgctgggacaactcatatcaagagggcggctgtttttccgcccattgcagaaaatgatggcgtgtctgcgggtcggccagtcggaaccaatatttcagccgctgttctgtcagagtttgtgattgcggcggtacggtatcaagctctgagacgtcggaaagtaatgtgctgtcgtctgccatcatcgtggcgaactgaggaagcgaggcgcgtttcgccgatttattataacgctcggtctctatttcataatcgaccactttagccgtagaagtaatggccagaatatcgagttttaccggaatgggcatggcgtcgccgtccaaaagcgccagacgcggcgccgcgttaaaatgcgaggcttcgcgctcgttttccagccgcgggagctggaaattgacctgacttatcagttgggtatcgaaacttatcaccagcggcggagaaatataaagccgctcttcattaccgggcaggcggatggttttttccacccggaaaacgagttgatgcggcccgttttccagttcaatgctctctgcgccgcgtaataaagagctggacacctttttgccgtccagcaccagcagatcaacctcattagacaaacggagcgttgtggcaaaaacagtcaccggcaaacagagagcaaggaaggtggctagcgcgccggttttcataaggttctcctgtccaaaggccgtctggctaataatgtatcgaaatttttcttagatcatgtttactaacatatagacatattttggcgttttgctctcatacatcggtatgggatgaatggttgctatgtcaggtttgtcgtacactttgcaaaacagccaggagaaagatgatgaaagagaccgatattgctgatgttttgacgtccactcgcactatcgcgctggtaggtgcgagcgataaacccgatcgtccaagttatcgggtaatgaaatacctgcttgaacagggctaccatgtgattccggttgcgccaaaagtcgcgggtaagacattgctggggcaacaggggtatgccacgctggcggacattcccgaaaaagtcgatatggtggatgtttttcgcaactctgaagctgcatggggcgtcgcgcaggaagctatcgccatcggcgcaaaaacgctatggctacagcttggcgtgatcaacgaacaggcggcggtgctggcgcgggatgcaggcatgaccgtggtgatggatcgctgcccggcgattgagatccctcgcctggggctggcgaaataaaagtttaaatggccggatatcgctttccggccttttaaatacaatcagttacgtagtcgcggcgcctgaagctgcttgcgaatggtacgcgccagttcatccatcgatggctgttctggatgctcgtcccgcatttcgcttcgcaactgggcctcggccagataagtatgcactggctgaccatcatcatcttccattaccacgtggtaccacggagcggcgcgaagttcgtcgttaaccgccagttcatcaggcgacggctcatcaagcgaatattccgggtcgatatcgacgaccactccgaggtaacctaacagggaatggcggacctgttggccgataccgaatttgctggctatcatagtcacctcccgggaaatagataccctttatatgaggatactattccacttttcaagttacatgacgcgacaggcaaaccctttcagatacagcccttccgggtaggtggcgatcaccgggtgatcggcggcctgacggaactgctctataaattgtacatcacgaccggcatctattgcggcatcggcaatgattttctgaaataaatcgctggtcatcagtccggagcaagagaatgtcagcagtatgccgcccggattgagcagttgaatcgctaacatgttaatgtctttatagccccggcaggcgcccattaactggcttttattttcaacgaatttgggcgggtccatgatgatgacgtcgaatttttcgccgtgttcacggtaagcgcgcagcaacttaaacacgtcgtcgcgcacgaattcggctttgctcaagtccagttggttcagttcaacgttttgcctggcgatatccagcgcatcctgtgaggtatccacgctgacaacctggcgacaaccgcccattaacgccgacacggcaaaaccgccggtataagagaagcagttcagtacccgctgattttccacgtagcggcgcgtcgccagacgactgtcgcgctgatcaagataataaccggttttgtggccgccctggatatcgaccagcaatttcataccgtgttcttcaattggcaaaagcgcaggcggcagttcgccagtgaccggaccttgcgtcagcgccatcccttcttttttccgcacggcgacgtcgctgcgatcgtaaatagcgcaatccggatagcatgtttgcagcgcgctaattaatgcggcgcgttgatattcggccccggcgctgagcagttgcagcaccaaaaaatgaccaaaacgatcgatagtgacgccaggcaggccatcggactcaccggcgatcagacgatagctatccaggccgtcttttttcgccagccagtcgcgccactgctgcgcctggcgcaggcggcgggtgaaaaacgcaatatcaatggattctgctttatcaaatgtccagacgcgcgcgcggatctgggaggctggtgaccaggcgccgcgtgctaaccactttccctgatggtcgacgatatcgatagtttcaccgaggttggctttgccttccagacgggatacggcgccggaaaagacccatgggtggcggcggagtaaagatttttctcgccctttgctgaggactaaacggggatattgcggaaatgtagattcagtcatgcggagtaacctctcacaaacagtgacgcgagccggatgatagttccagcctgggaccgtgaaaacgaaatggcgcgtagggtagcacagatgagaggggcaatcaccagcgtatggcggtgagcgtttctgcacaaaatagaatcgtaaaggcacagtttcttcagcggacgctttttatagtgttatttctttacacgaagaaggaaatacaatgaaaacagtcttctctttgaccgcagccgcaatgatggcattgagtggcggcgtatctgccgcgtcggcgtttagcctcagtagcgcggatattccggcggattttcgtttaacgcaacagcacgtctttaaaggatttggttgtagcggagaaaatatttcgccgcagctgagctggcgcaatccgcctgccggaaccaaaagctacgctattaccgtcttcgatcctgatgcgcccaccggaagcggctggtggcactggacgatggtgaatattcctgcgcagattcacgacctgccgacgggggctgataaaaaaacgttacccgccggagtggtgcagggacgtaatgatttcggttatgctggctttggcggcgcctgtccgccgccgagcgataagcctcatcgctatcagtttactgtgtgggcgctgaatacggcaacactgccgctcgacagtgagtcaagtggcgcgttggtagggtttatgctgaacgcgcatgtgattgcgaaagcaaaattcacggccacatacggaagataaaacagaggacggcacggtgcaggagatgcatattcgacatcaggatcttacgacggcagaggtgcgttccagtcatctgcaccgtttgcatcgtgttacgcttttttccgccgctatctgccatattacgcagggcagtaaagtcatcattcaggatgatagccgccttgtcgccgggcctggcgagttgattattatcccggcgaacacgccgctggagattattaatcagcctgcgcagaacggttttcgctccgacctgttattactttcaccggagattattgctcgctttaaaacgatgtacgttcaggattatccaccggcaaacctgacatcgctgtgtaccccgatgagccgtagcctgacatttatgtgggagaacgtgttggatgctgtgcgccaggggttgcccgttgggctacaggaacatcaggcgatggggttactgttagcgcttttacatgatggcgcggcgggaccactgcttattgaacggcgttacaccctcacggagcaggtgcggcaactgattatgctctcgcctgctaagctatggacagcccaggagatagcccgccgtcttgctatgggaacatcgacgttgcgtcggcgtttgcagcgtgaatcgcagagttatcgacaaattgttgaagaggtgcgcatgtcctgcgcactttctcaactgcaatcgacgacgctgccaatcggcgaaatagcgctacggtgcggctacctgtcggggtcgcgatttacggccagattccgccagcattatgggtgtctgcccagtcaggtacgttaagtatgtcctgtatgagcctccaccgttgattatgaaaggagaaccatcatgtcgaacgtctgcattatcgcctgggtttatggtcgcgttcagggagtcgggtttcgctataccacgcagcatgaggcgcagcggctggggttaaccggctatgcgaagaatatggatgacggaagcgtagaagtggtggcctgtggcgacgcggcgcaggtggaaaaactcatcaagtggctgaaagagggcgggccgcgctctgctcgtgtggacaaaatcctcactgaaccgcacagccctcgcgagacgttaacaggctttagtattcggtattaaatacattttaccggcttgggcagaccggcgattttggtcgcttgctttgccgggcctttcgggaacagacgatacagatagcggctattgcctttttcttcgccgaacttattcgccatcgcttttaccagcattcggatggcgggagaggtattaaactccaggtaaaattcgcgcacgaagcgcacgacttcccagtgttccgcagagagctcaatgccttcattggcggcgatagcgactgccagcgcttcactccactgcgtcgtctctttcagatagccttcgctatcagtactgatttctttaccttcaaagatcaacataacgtttcactgcgtaatcaacacggacggcagtgtagcaaaaaataaagccctgcataagcagggctggaagaggggaatgtcgattagtcgcggctggcgaagcccagaatgctgagcaggctgacaaagatgttgtacagcgaaacgtacagactgacggtcgcacgaatatagttggtttcaccgccgtgaatgatgttactggtttcatacaggatagcgcccgaggaaatcaggataaacaccgcgctaatcgccaggtgcaatgcaggcagttgcaggaaaatattcgccaccataccaatcagcacgacgacgatcccggccattaacataccgcccaggaaagacatatccttacgggtggtcagaacgtaagcggagcagcagaaaaatactaacgcggttccacccagcgccaggccaatgacatcgcccatgcctgctgacagataggcgttaagaatcgggcccaggatatagccgaggaagccggtaaacgcaaaagcagacaggataccgaccggcttattggcggttttataggtcaggaacatcagcccatacataccgaccagcgtcagaatcaggccgggggagggcagcatcagtaccgtactggctgtcgcggtaattgcggataaagccagcgtcaggctcaacagaaaataggtgttgcgcagtactttgtgcgtactcagtagcgagctacgatcacgcgatgatgtaatgatacgatccattagtcactctcttatgacagatgtaattaataaaggagaataataaaaacagtcactgtcacccagtggttttacccatctttacgcattcgtttacgtttagtttccttaagagatttcaggtgattaccgtcgttaaaacggtctgctcatgcctggcgctacgccataaaacaggcggcagcgccaaccacgcgttaccgataaaaaaatcgctaatcacagcggtgaaacagtggaggcgatcaatacgtattcagccagttttgtgttgaagaaatggtcaatgtgccgctatttcaggcaattaacgaaattttgcctgtttttcacgcaaacgaacacattcggtctttacatggcgcaccgggatgtttatagtgcgcctcattccggaagtgtggccgagcggttgaaggcaccggtcttgaaaaccggcgacccgaaagggttccagagttcgaatctctgcgcttccgccagattaaacaaggggttaccgaaaggtagcccctttgtttttttaggcgctatagaatatagttagaaaatactgttagaatatttcccgaaaaaacggactacgcgagtctttagtttcttttcgtttcccgatgtgtctatttattgaagatgtagaccattctgggaggtgaaggatgccccatctctttcagaataatgttggtatattcgacaacagggcctcttggatgattttcttctttatcctgaagatgggtcagggcatgtacaacttcatgaataaatgaacgttttgtgtcaaaaagttgtcttccttcgttactttcataatgttcggtatatgaatcatcagaatcgtccagattgagacaaataactttcctgccttctgaaagtttgaagtgttcctgagccacggtagtttcaaaggcttcgcctgcccccagtagccagcgctgctccacatcatgtagttctttttcatatgcgtaattcatcagtctgcggaatgtttcgctttgggtatacgcattttgaagtacggaggatagttcatcgtagcattcgtcataagtgtcgtcatcaatttctgtatcagggtctattccacccgcgcctgagataaggtactccaccacacactctggctccagacggaattcactgtttatggcaaggctgtcatgagcaaggcgtagccgtgaggggtttggtgcatgttcgggaatatcggggaaaacaggtgtatctgcggtatttaatctatatgtggatactccgctttgaggtattaatctgtaggtgaccggaagcataacttcttatttcctgactacaattatgaattatttaaattaaacaataatagtgtttttagttaatgtgccacatacaggtaacgctatgattcagacaaagccaacaagtaatacgctgaaaatgttatttataatgaaacttaggggcggggtttatttaataaaacaagggggcctctgtttgaatacttcttgtttataaaatccctttatctcgactaaaatatcggatgggggaaaagagttctatcattgtaatccgggagtggagtaggggtatgttgactacctgtcagatcggctcctgttaatgctttcgctaaagttagagctatcttatctaatttcgcaccatttagtttggtgtcagttaagtctgagccgaatagaattgcagcggttaagtttacaccggacatgttagcgcaagtcaggtctgcgtgagtcaggtttgctttagtcatgtttgaacccattagatttacagcgtgtagatttgcacaacacaaatttgcaccgactaaatttacattagatagagttgtttcacggaaatctgcattagaagcatctatttttgacaaatcttccccctggaaatctttatgagccaggtttactccgcgcaggttcagaaaaccatcctcggttataagtgaatcaggctgttgtatattatgtttactcatcagttttaacattcgacatacattccaaaatctctcactatcaactttatccgttacagtttttccatttttgttcacttcaataatgaccatgggatccgtattttcggatgctgctccacatgacagacatatagtacacccgttgacatcctccagaaatattttattaccatcgaagaaagcatttttatttacatataataatgatgtggtcagttttccaattacctcccgaaaccatctttcattgcttcttcttactccaccacaggtaaaaaaattgacaaaccattccagtataccgcgtggtgaagttgcacttttcattgcttctttcgtaccggtaccggccgcatgcaaatatcttaatatattttctggggacgcgttagttattggcattttgattccttcttatggaagtgagccgactccttataggtgtgagtcaagtcacatttatacaaggaataataaaaaaagatataaggtgatttttgtatttagagctttggttgagtatgagtaggtgtctggcatctgacaagaggcgatgatatctgccataacggtgaagcagaagtaatatcacccgtgaataataagattatccttgctattgacttccttcatttccagcatagcttacgcttcatcatcattgaataaacaattaagtttgttgagcgaaaatttacttaaagaaaaaataataagcaccaatattttttgcagtatttcaacttataccagaataaatgcgcgtagatggcgtaaaaacctgatgagcaggaatacttacacactaaaaatgctcccgcaaacagagcaaaatgagagagatgaacgtttgccccttacatttccaccaaagattctggtcttgtctcttgtaaagggcatacgtatcgcgttttatctcattaagaaagtatgttgacgtattaaattatgcataatgctctttcaattgcttcacgtttgaaatgaataattcaaaaccagtgagcgcctcttcttcggtactggtttgcggcaagcgataaagcgccactaaagcagtattgtctgcgtcagcgccgatagtgacggcgctggtgtagttcagacgtaaaaaatgctgcaaagtcaggatgtcgtcaggcaatggcataaagggacagcacatttccagtgtatgatcggattcattaaaataaacctgtatcccatcatcaatgataagcagtggctcatcttctggcgcatccaggcctaacgcgtcatataaacgatttaatagactttccatatagttacctcaagactcaagatgtgattaatgaagaaatgccttttactgactgccaaatattttcatccccaactcgtttttgataggaaagattgagcacctctggcgataaatttttcattactttgtttcccgccccgcccgtattttgtttctgaatctccaggttaccgctattcagtaatactttttggaaaattttctgtccaccgctatccggaagactaccaggcgcacttaacatatgggtctgatgtaaggaaatgatctctcgcttgatttctgaatccatcatccctgtacgatctttgccgcttttacaattccaggcgggtaccgcgtcaatttcatgggctaacatggcaaggcgttgtgcgagtttatagggttcgccgccatctttatgatgttggttatttttccatatatccttaatctggcgcgctaatgtattgacgacctcataattatccgggtattgcgccagccattcgccaacccagccacctggtctggcttcagggcgtaaatcattgcctaataactgatgtagcgcctcggcattatagctatccgatgccttaaggccaaagccgagcttgagcgccagctcattaacacccacattaaatgcggcgacgtccggttttatttttaccgtctgtagatcgccatctttattgcggatttttaaatgaatcatttttcccggctgggtcaacgattgccatgcgcgcatttggtcctcgaccatcgttccctctttgccgaaaatattcgacgcggtgagtaacccgacggataccagtttcaggcttaccgcctcgcccgctaaggctttgttaagcaactcaggtttactaaaaagtgccgcagttaatacttctttggctttgttttcagcgccgacgtgacgcagaagcggatctttttcatgatagggggaaagcacgccatgacgtatcccgcaaaaaagcgttttatctttaccgtcctcatgcacactcaccgtggacatccacaaattattggcgtgatgaatattcttggtatcccaactgcatacgccctttccctcataagcactgggaaagatatcttttgcgccgattttcatctctgctgcagggagctgcgtgttggtatagtgatgcccgttatgcgtgagtgtattttttatggtttgccagggctggttattaagctgcttgacctgagcatctctaaacgctactgccgcaaagcgatgagcttcttttgcaggtaagccatcctgctgctgagtgcgtgctgcaataagttcgataagatttttcttcaatgcttttgccgcggcttcttcttgttttgttgctggccggtccgctttaactttggctaactccatttggtttgccattgacgttagaaccgggtcttgtttacccagaacggttgccgcgacggtaagaagatcgcgctgtaagttatagaggttatgcagcgagtggttagacgccttctgatgctgtagataattcccccatgtcgcgccgggttctcgcaggacaataatttccgggcgagcgtcgggcgctttagccggcgctttgccctggcctgagagaatctgcattccgttgtataaggttttttgtaggcttttaaaagcctcctgggtttttagtgaagctgagtgatagaagctctgtatttgcatagcgtttttaatattcctgaataggggagtgggaacattcaacagggttaacaaccctttaaaaggatgtgacttttatgcaccaggaactttaaaaaaatgtcctttttaatgaggaaacgcttctgatcaggcggggaggcatcctgacgtccatacgtagtggcgatcatgggggagatcggtacatcaaatgttcataaaatctacaaacttcacaatttatggcacaacttttattgaaaacccaccttcttgactcagatcaaattcaccgatttactcctgcgtaaagtaacggcgttacatcaaatgttatacaggtgtgtgtatgccagcaaagccccggacaagtaagaccgtgacgaagaatattcgtttttcctattccatgcttgaacagatagaattcgcgttgaaatctgaaaagacgcggaatttttcagcatgggtaaaagaggcctgtcgggaaaagttatgtaacacgggacataagctgtagttatcgtcttatgtaagagggggcggccattttgaaaagaacaacgtgcttatatacctcctgggtttttgccgcttttgtctctctgctgatatttgcctggagtgtcataaactatcctctctatgaatccataataattattgtcttttatatctggctaattctggtaccgctttatcttattgtgtatgagtggctaatagattgtcattaaatttatggctgcgtacttgaaaagtgatatttcatatctgtacggtaagtcattgtcgtaataatattattggtcaggcgacgggcgagcgtctgcgcattttgcatcgttttatcttcaaaattttgcagtaagcgttgcgcttctttcggatgcgacgcatataatctcagatagctctgctccatcttatactgctgcttagctgtttgctgttcaaatgttttccaggcgtgttgcacatctggcgcaaacgcattgtagtcctgcataaccagcgtttgcagcgtgcggaatgtccagtaggtagagtcgttgctcgcccgatcggttcctttatcatctccgggttgataatgacgcatcccctgataataggggagatagacgctaagagatggcattccataggcgatgtattctacgttgccgatagcctgcggtaatttcggtctgacctgtaaaatatgtgactcctgggtacgaaaaacggatataggtcgccatggttcttgtggattatgactggcataagggtcgtgcgacgttccctgatagtgattgcgtagcgcgttttttactgccgccacgctgatcttcgttattggcgttaaaaaaacaggaaatgtttccccttcgctaacgaccgtatccagatgcggattaaactggtgttgtagcgtccagacgcgcggataattataggtggtatcgtttttgttatcctgcgaataggcttgatgaaagtcgaattcgccgcgggccggatcatataatccctgctttttcgcaaagcttactaacgttggtgacgccatataattcgcgttatcattcggatcgtaatggcgtaaacgtccctgattggcggaaacgaaatagctatctgccggaagtcgtactgccagccattgatgaccgcttcccgtctccagataccatatctctttgctatcaataaacgcgacgccgaaaccttcgcccgcgcctttttgttcaataatatctcccagtaatttggcgccctgacgcgccgattgcgccactggcaggatcacggactcaatggcgtcttccgtgattcccgtttttgtcacgtaaggatcggcagccagcgccgctctgccgttataaatggtttccgttgcgctcattccgacgcccgccgaattgaaaccggcttcacccatggcgttatcgttagtatcaaagtcatgaatcgccgtatagcgcatcgctgtctccggaagcggccagctaaaattgttccgatgtgctttatactcgccttgttgatgaaacgcgatgggatgaataaccttatgcttggcgttatttgccgagccatcttcgttgcgcgcgataatgaaggagccgtcagccgaagcctgattgcctaccaaaagggtagtacaggcgatgactttacccatacccagcagcgtaacggcgaatgcaagatactttttcataaaggttcccactgaataacgcattatgggatgaattgaccctggattggaaaccgagaaagtgatcgagccagcaatattctttgccggcatcctttattttctctttattgaggttgtattgataaccacagccctgtggcagggaaggggaacagaacctgtcctgaccttagctatcaccactatcaggcagacgaaccgaaaagatattatgttcatcggcatagcggtaagatgccgagccaccgtgtaatagagcaatcgcgttaactaacgataaccccaggccgaaaccggcagtgtggcgggcattatctcctcgccaaaaacgccggaaaagcttatccgcatcggcggggtggctgcctggattagcgacccgaatttctgcaacgttatcatcataagcgctttcaatacgtatcacggcgttttcatcagaataacggatggcattcgtcagcaggtttgagagcactctttgtaataatatttcgtcagcccataccgttccctgacattgatttataaaacagatgcgcttctcctcggcaagggggctaagataatccagcatattttcgaccagcgcattgagcgaaacaggctgtttttttaccgctatattctggtgctccgcgcgtgccagaaagagaatattttctgtcagtcgcgacagtccctccagctcttcaatattatcgacaagggcttgttgatactcttcggcgctgcgttcctgactcagcatcacctgattcttccccagtaaaatattaaccggcgtgcgcagctcatgcgccagatcgtcggcaaattggttcaggcgttcaaaatcgtcggaaagcttctggcgcatggtatttagcgcttgtccaagcggcctgagctcaacgggtaacgcctgttccgccaacggctggcgaagtgtgccgctatctgtcgccgcggtgagtcggctgagcgacgtaatggcccgcagcccgtttctgatgactaatggactgagcgccgaacagacgaggatcgcgataaggctcatcagcaaactgttgcggcgatattgcgccagcatttgccgcctttccgtcgccagcctggcaatagtaagggtcagcgggtcatcgccgcttctggcgcttacgcgtaccgcggtcagttccgtgccttgtaccgcctggcgaaataaggtttcgcgggtgatgtttttagtcagcggaatctcgttaaagcgttggtcggggatgccgctatgattaatcgcaacattgtggcctgttgctgaatggatcaataagatgtcctgcttcgtatccaccatccgattgaaatagagcggcagattttccggcctggcgccatccagtaacagttgctgcatttgcgccgcccgatttattagcgtcatatcatcccgatacgttaattctttgctcagcgcgttatagagcgtccagctaatgccggtacaggcgaggataaggatggcgataaaagaaattgtcaggcgcagcgtcattgataacttaaccattctgcgacgtttccgcctgtaatcgataacccatcccccggacggtcataatgagcttcttttcaaatggatcgtctactttggcgcgcagccgacgaatcgcgacatcaacggtgttggtttcactatcaaagttaattccccaaacttcgctggcgatcgcggttcggggcacgatttctcctgcccgggacgccagtaaccagaggagcaggaattctttgcgggtcagggaaatcggtttgccatttcgtgacactgattgctttgtggcatccatgtccagaccattgatcgtcagtcgagtaaaggcagggacatgctgtctgagttgagctctcacccgggccagcagttcggcgaaggaaaaaggcttaacaaggtaatcattagcgcccgcctcaagacctttgacgcgatcctcaaccgagtcgcgcgccgtcaggcaaataacaggggactgatgcgcagtgcgtaacgcgcgtaaaacctgccatccatcaagccccggcagcataatatcaagaataatcaatgaataatgttcctgaagggccaggtgtaatccgtctcgtccatcacaggcataatcaaccacatagcctgcttccgtgagtccctgacgtacccactcaatggttttctggttatcttcaatcaataaaatcttcatcaacgcagtatgccataggcttgttagcgaatccgtaaatctccaacaagatgacataattgtcatgtccgtgtaaggttaatcctggacgcgccagatatattttcctgcatcaataccgtaaaggagtgaagcatgaaacgatatatactggctaccgtgatagcatctcttgttgcagccccggcaatggcgctggccgctggcaacaatattctcagcgtacatattctcgatcagcaaacaggtaaaccggcgcccggcgtggaggtggtactggagcagaaaaaggataacggatggacgcaattaaacaccgggcataccgaccaggatggacgtattaaagcactgtggcccgaaaaagctgccgcgccgggggattatcgcgttatttttaaaaccggccagtattttgaaagtaaaaaactggatacgtttttcccggagattcccgtcgagtttcatatcagcaaaacgaatgaacactatcatgtgccgctgttattaagtcagtatggttattcaacctatcgcgggagctaatttagagcctatcccattagggttattttacttgccattttggtcctgggcagtgctcgccaaaacgcgttagcgttttgaacgccgcttgcggcggcccgaagggcgagcgtagcgagtcaaacctcacgtactacgtgtacgctccggtttttgcgcgctgtccgtgtccaaactggctgcgccaataacgcctggtgggataggctcttagattgtattaatcgccgcgatttatggcgagcaaacatcgcggcgggaataaaaatcttcagcgtatcgactcttctcccacaagcggtggttatcccgcttgtgggcatgagtgacggttaaacaggcgcttccatctcaagtctgaccggatgaaaacggcgtttgaaataaatcaggccatgcccatcctggctaagaataatatttttgatcgccaccagatacaccagatgcgtgccaatggtttgtacctcgctgatctcgccttcaagaccggccagcgcgccgttaagtaccggctggcccagcggcccgttttgccaacatggctggtgaaaacgctcttccatcgccatccccgtcataccggcaaagtggcgcgccatcagctcctgctcatggttaagtacattaatgcacagcctgccgttaccctgaaaaacggggttcatggcgctattggcattaatacataccattacggagggcggcgtatcggtgacggaacagaccgctgttgcggtgataccgcagcgtccggcgtgacccgccgtggttacgatgttgaccgctgccgccagacttgccatcgcatcgcgaaaacgcagacgttgttcatctacttgcatgagaacctcctgccgcgttatttcagcagcttatccagttgattgatgtcgtcgttattgtgcaaatgcgaaaccgtccagccattctgatcgtattcggagaggcagcgatcaaccattgccatcatcttatccatattgccggagctctgggcctgacgcaggcactgcagacgaatttcatcctggctgcccgagtagttaatctcgtacagctcatggcgaccgccaaactcgctgccgatggcatcccacatcaatttaagaattttgatacgttcaacatggtccattccgttagagccgcgtacgtatttcgccaggtactggtcgatttgcggattattcagatcgcgggcgctggaaggcaggtaaatcaggccgctggtaacgttacgttcaataatatttttaattttcgcgtaggccattggggccatcacacgataggtttgcagcgcggcgtggtccggtagccaggcgccgtttacccacggggttgcttcggaacacatagaatcgctcaatgcccagaacatattgcgccaggccacgacttcgccgagatcggcctgcacgccccggaactctacggtacccgtacattcgagcgattttttcagcagcgcggtaatgaaatcaagtttaaccgccagacgaacacaggcttgcagtggatacatacgggcaaagccgccttccatcgtccagcgacggcaacgatcgaaatcacggtaaattaatacgttttcccacgggatcagcaccttgtccatcaccagaatggcatcgttttcatcaaagcggctggagagtggataatcaaacggcgagcccgtcgcgcccgcgaccatttcatacgaggcgcgcgaaataagttttacgccttcggcatccattggcgcgacaaacatcagagcaaaatccgggttttcgcccatcacctgggctgagccgaaaccaatcatgttgtagtgagtcagggcggagttagtggcgacgactttcgccccgctgacaataatcccggcgtccgtctctttctccagcttgatatagacgtctttcacttcgtcggcaggtttgtggcgatcaatgggcgggttgacgatagcatggttaaagtacaggccggtctcctgaatacgggtgtaccagttacgggcgttctgctcaaactggccgtagaaggctgggttagcgcccagagcgcagccaaaggcggctttgtaatccggtgtgcgtcccatccagccgtaactcaggcgtgaccactcggcgatagcatcacgctgttggcgcagatcgtctgcgcttttcgccacgcggaaaaatttatgcgtataaccgccgctgccggtatcggtattccagcatagggtatcttgcatcgacggtttatgtaatgcgtcatacagttgtgcgacagaggctgcggcattgcggaatgccggatgtgtcgtaacatctttaacgcgttcgccgtaaatataaatttcccgcccgtcctgcaggctttttaaatactcttcgcccgttaacggacgcttgttatcagtacgaaaatcttcaggtttcattgcggcctcttcctcgttaatcggaatgttttgttaataatatgtttcttatttgttgttcaattgaataggcagaagcgtaaactgtgaagagactttcaggacaacggcgggtacttttcagatgaacgtcgaagaagaagagtaaaatgcgatcgccgtcaacgttgtaagcgggaggggattcccgtgtcggcggcgtgggaaggtaagaatactatgcttccgcttcgctatcaggatgctggcgtcccagagcaataagatcgtccagcagcagcatcaattgctgtgttttttcgggcgtgaaatcggcctcaatttttcgataagcctcttctacctggcttcgggcacgggcgtacaacgtttgtccctgctccgtcaacatgacatataacttacgctgatcgttaaccggcttgagtcgcaacaccagtccgtctcgctccatgcgcgtcaatattccggtcagacttggacgcaaaatgcaggtacgaaaggccagctcgtgaaaatccatagaggggctatcggccaggattcgcacaatgcgccattgctggtcggtcagattgtggcttttaacgatggggcggaaataggtcattgccgcttcgcgcgcctgaagcaatgcgatggttaatgaatcatgcataagcgtttctcttttgcagaattattaatacctgaataatcgtgtttaccgatgtgagctatgacatctgttttatgtccaaagtttaacagaaacaaggggctttatttaactatttgatatgtatgtgtttaataataaatttgtgaaaatattgttaatcacatcacaaatactttacttcagcttgctaaatgtacagcgaaagcataaatctaatcattaatatattaatgaaatcacagcccgttaaatcggcctgaggagtttatgtatgaagggtactgttttcgccgttgcgttaaaccatcgcagccagcttgatgcctggcgagaggctttctctcagcctccctataatgcgccgcctaaaaccgcagtgtggttcatcaagccgcgtaatacggtgattcgtcacggcgaacccattccttatccgcagggagaaaaggtactgagcggcgcgacagtggcgctcattgtggggaaaaccgccagccggatacgccctgaagcggcggcggactatatcgccgggtatgcgctggctaacgaggtcagcctgccggaagagagcttttatcgcccggcgattaaagcgaaatgtcgcgatggcttttgcccgctgggtgaaatggcgccgctgagtgatgtggataacctcaccattatcacggaaatcaacggacgagaagcggaccactggaatactgccgatttacagcgtagcgccgcacaactgcttagcgcgttaagtgagttcgctacgcttaaccctggcgatgcgatcttactcggtacgccgcagaatcgcgttgcgctgcgtcccggcgatcgggtgcgtattctggcgaaaggtttacccgctctggaaaatccggttgtcgcagaagatgaattcgcccgccaccagacttttacgtggccgctgtcagcgacgggtacgttatttgcgttggggttgaactacgccgatcacgccagcgagctggcatttacgccgccgaaagagccgctggtatttatcaaagcgccaaacacctttaccgaacatcaccaaacgtcggtgcgcccgaacaacgtcgaatatatgcactacgaagccgagctggtcgtggtgattggcaaaacggcgcgtaaggtgagcgaagccgaagccatggagtatgtggccggttacaccgtctgtaacgactacgcgatccgcgactatctggaaaactactaccgtccgaatctgcgggtaaaaagccgcgacggcctgacgccgataggcccgtggattgtggataaagaggcggtttctgatccgcacaacctgacgttacgcacctttgtcaacggtgagctgcggcaggaagggacgaccgccgatctgatcttcagcatcccgttcctgatttcttatctgagcgaatttatgacgttgcaaccgggcgacatgattgccaccggtacgccgaaagggctgtccgatgtggtgccgggggatgaagttgtcgtggaagtagaaggcgtgggccgcctggttaaccgaatcgtcagtgaggagagcgcaaaatgaagaaaataaatcattggattaacggcaaaaatgttgcaggtaacgactacttccagaccactaacccggcgaccggtgacgtgctggcggaagtggcctccggcggtgaagcagaggtgaaccaagctgtcgcggcggcaaaagaggcgttcccgaaatgggccaacctgccgatgaaagagcgcgcgcgcctgatgcgccgccttggcgacctgattgaccagcatgtgccggaaatcgcggcgatggaaaccgccgacaccggcctgcctattcaccagactaaaaacgtgctgatcccgcgcgcctcgcataacttcgaattcttcgccgaagtgtgccagcagatgaacggcaagacctatcctgttgacgataaaatgctcaattatacgctggtgcagcccgtcggcgtctgcgcgctggtgtcgccgtggaacgtgccgtttatgaccgcgacctggaaagtcgcgccgtgcctggcgctgggcaacaccgcggtgctcaaaatgtccgagctgtcgccgctgactgccgacaggctgggcgagctggcgctggaggcaggaattccggcaggcgtgctgaacgtggtgcagggctatggcgcgacggcgggcgatgcgctggtacgccaccatgacgtgcgtgcggtgtcgtttaccggcggtaccgccaccggtcgcaatatcatgaaaaatgccgggctgaaaaaatactcgatggagctgggcggcaaatcgccggtgctgatttttgaagatgccgacattgagcgcgcgctggacgccgcgctgttcaccatcttctcgatcaacggcgaacgctgcaccgccgggtcgcgcatctttatccagcagagcatttaccctgagttcgtgaagcgctttgccgaacgcgcgaatcgcctgcgtgtcggcgatccgaccgacccgaacacccaggtcggcgcgctgattagccaacagcactgggaaaaagtctccggttatattcgcctcggcattgaagagggcgcaacgctgctggcgggcggtgcggaaaaacccactgacctgcctgcgcatctgaaaggcggtaacttcctgcgcccaaccgtgctggccgatgtcgacaaccgtatgcgcgtcgcgcaggaagagatctttgggccagtcgcctgtctgctgccattcaaagacgaagcggaagggttacgtttggcgaacgacgtggaatacggtctggcctcttatatctggacccaggacgtgagcaaagtgttgcgcctggcgcgtgggattgaagccggcatggtcttcgtcaacacccagaacgtccgcgacctgcgccagccgttcggcggcgtgaaagcctccggtaccgggcgcgaaggcggcgaatatagcttcgaagtgtttgcggaaatgaaaaacgtctgcatctcaatgggcgaccatcctatcccaaaatggggagtttgatatgggcaagttagcgttagcagcaaaaattacccacgtgccgtcgatgtatctttctgaactgccgggaaaaaatcacggttgtcgtcaggcagccattgatgggcatattgaaattggcaagcgttgccgcgaaatgggcgttgacaccattatcgtattcgacacccactggctggtgaatagcgcttaccacattaattgtgccgaccatttccagggcgtctataccagcaacgaattgccacactttattcgcgacatgacctatgactatgacggcaatccggagctcggccacctgattgccgacgaggcagtcaaactgggcgtgcgcgctaaagcgcataacatcccgagcctgaagctggagtatggcacgctggtaccgatgcgctacatgaacagcgacaagcacttcaaagtggtctccatctcggcgttctgcactgtgcatgattttgccgacagccgcagactgggcgaagccattctcaaggcgattgagaaatatgacggtaccgtagcggtattcgccagtggttctctgtcgcaccgttttattgacgaccaacgggcggaagaagggatgaacagctacacccgcgagttcgatcatcaaatggatgagcgcgtggtcaagctgtggcgcgaaggcaaattcaaggagttttgcaccatgttgccggagtacgccgactactgctacggcgaaggcaacatgcacgacacggtcatgctactgggaatgctggggtgggacaaatacgacggcaaggtggagttcatcaccgacctgttcgccagctccggtaccggccaggtaaacgctgttttcccgctgcctgcgtaaggggtgtttatgccgcactttattgctgaatgtactgaaaatattcgcgagcaggctgatttacccggcctgttcagcaaggtaaacgaggcgctggccgccagcgggattttccccatcggcggtatccgcagtcgcgcccactggctggatacctggcagatggctgacggtaagcatgattacgcgtttgtgcatatgacgctgaaaatcggcgccgggcgcagcctggagagccgtcaggaagttggcgaaatgctgtttgggctgattaaagcccacttcgccgacctgatggagaaccgctatctggcgctgtcgtttgagattgccgagctacatccgacgctcaattacaaacaaaacaacgtacacgcgttatttaaatagcacactctttcgcccggtggcgctgcgcttaccgggcctacaaaaaaacgatgcacgaagcaataccgaaccgtaggccgggtaagacgcacccgcgtcgccacccggcacagcagcaccgaatgacgtaacaggaaacactatgctcgataaacagacccataccctgatcgcccagcgacttaatcaggctgaaaaacagcgcgaacagattcgcgcagtgtcgctggattatcccaacatcactattgaagatgcctatgccgtacagcgtgaatgggtcaatatcaagattgccgaagggcgcacgctcaaaggccacaaaatcggcctgacctcaaaagcgatgcaggccagctcgcaaatcagcgaaccggattacggcgcgctgcttgacgatatgttcttccatgacggcggcgatatccccaccgaccgttttatcgtcccgcgtattgaagtggagctggcgttcgtgctggcgaaaccgctgcgcggccctcactgcacgctgttcgacgtctacaacgccacggattatgtgattccggcgctggaactgattgacgcccgcagccacaacatcgacccggaaacccagcgtccgcgcaaagtgttcgacaccatttccgacaacgccgccaacgccggggtgatcctcggtggtcgtcccatcaaaccagacgagctggatctgcgctggatctccgcgctgctctatcgcaacggcgtgatcgaagaaaccggcgtcgccgcaggcgtgctgaatcatccggccaacggcgtggcgtggctggcgaacaagcttgccccctacgatgtccagcttgaagccgggcagatcatcctcggcggctcgttcacccgcccggtgccggcgcgcaagggcgacaccttccatgtcgattacggcaacatgggcgcgatcagttgccggtttgtgtaaggaaaaaacgatgaaaaatgctttcaaagacgcgttaaaagcggggcgtccgcaaatcggtttgtggctggggcttgccaacagttacagcgctgaactgttagcgggcgccggcttcgactggctactgatcgacggtgaacacgcgccaaacaacgtgcagacggtgttgacccagttgcaggcgattgcgccttatcccagccagccggtggtgcgtccgtcatggaacgatccggtacagattaagcaactgctcgacgtcggcgcgcaaacgctgctgataccgatggtgcagaatgccgatgaagcgcgaaacgccgtggcggctacgcgttatccgcctgccggtattcgcggcgtgggcagcgcgctggcgcgggcatcgcgctggaaccgcattccggagtatctccacctggccaacgacgccatgtgcgtactggtgcagattgaaacgcgtgaggcgatgagcaatctggcgtcaattctcgacgtggatggcattgacggcgtgtttattggtccggcggacctcagcgccgatatgggctttgccggcaatccgcagcacccggaagtgcaggcggcgattgagaacgccatcgtgcagatacgcgcggcggggaaagcgccggggattctgatggccaatgaagcactggcgaaacgttatctggaactgggggcgctatttgtcgccgtcggcgttgacactacgctgctggcgcgcggagcggaggcgctggcggcgcgctttggcgtagaaaaaaaactgtccggtgcgtccggcgtctattaagcctggccccgtaagcgcagcgctaccgggcaaccgtagtaccctacaaaattcccatcagaggaaaaaaaatgagcgacacatcatctgcacttccggaaagccccgagtctgtcagttcgcacaacgcgctcagcacgggtcaacaaaccgtcataaataaactgttccgccgactgatcgtatttttattcgtgttgtttatcttctcgtttttagaccgtatcaacatcggttttgccgggttgacgatggggcaggatctggggttaagcgccaccatgtttggtcttgccacgacgctgttttacgctacctacgtcattttcggcattcccagcaacgtgatgttgagcatcgtcggcgcccgccactggattgcgaccattatggtgctatggggcattgcatctaccgccacgatgttcgcggtgggaccgaaaagcctgtatgtgctgcgaatgctggtgggcattaccgaagcgggctttttgccaggaatattgctctatttaacctactggttcccggcatttttccgcgcccgcgccaacgcattatttatgattgccatgccggccactaccgcgttggggtcgattgtctccggctatattttatcgctggacggcatattcaatctgcatggatggcagtggttattcctgttggaaggatttccgtcagttttgttaggcattatggtctggttttacctggatgataccccggcaaaagccaaatggctgacggcagaggataaaaaatgtttgcaggagatgatggatagtgaccgcctgacgctggttcagccggagggggccatcagccataacgccatgcagcagcgtagtctgtggcgcgaagtattcacgccaattgtactgatgtatacgctggcctatttttgccttaccaatacgcttagcgccattagtatctggacgccgcaaatcctgaaaagttttaatgaaggcagcagcaatatcaccatcggcctgctggcggcgatcccgcagatttgtactattctgggcatgatttactggagccgccattcggacaaacatcaggagcgtaaacatcacacggcgttgccgttcctgtttgccgccgcgggctggctgctggcgtcggcgaccgaccataacctgatccagctcctggggatcgtgatggcatccacgggttcctttagcgcgatggcgatcttctggaccacgccggatcagtcgatcagtttacgcgccagggcgataggcattgcggtcatcaatgccaccggcaatattggctccgcgctcagcccgtttatgattggctggctaaaagatatcaccggtagcttcaatagcggactctggtttgtcgcttctctgttagtcgtcggcgccgccattatctggcttattcccatgaaagcatcgcgtccgcgcgccaccccttgaggagaaactatgtgccaacgtgcgatcgccaatattgatatcagcaaagagtatgacgaaagcatgggcagtaacgatgtgcattatcagtcgtttgctcgtatggcggatttctttggtcgtgatatgcaggcgcatcgccacgaccagttttttcaaatgcactttcttgataccgggcagattgagctacagctcgacgatcatcgctattcggtgcaggcgccgctatttgtgcttacgccgccctcggtgccgcatgcttttattaccgaatcggatagcgatggccatgttctgacggtacgcgaagagctggtttggccgctgctggaagtgctttatcccggcaccagagaggcctttggcctgccgggaatctgcctgtcgctggcggataaacccaacgagctggcggcgctcaaacattactggcagctaattgagcgggagtccacggaacaactggctggctgcgaacataccctggtgctactggcgcaggcggtatttaccttgctgttgcgtaatgcgaagctggacgatcacgccgcaaccgggatgcgcggtgaactgaaactttttcagcgctttaccctgttaattgacaaccacttccatcagcactggacggtgcccgattatgcctgcgagctgcatattaccgaatctcgtttgaccgatatttgccgacgttttgctaatcgcccgcctaaacgcctgatttttgatcggcaattacgcgaggcgaaacgactgctgcttttttccgacaatgctgtcaacgagatcgcctggcaattaggttttaaagatccggcttattttgcccgtttctttaatcgccttgctggctgttctccttcgcagtttcgccaacgtgaagttccctcttttctcaactaagaagagtaaaaacatgatgaaaaaaagcgtcgctatgctggcggtgtgtatgctggcgcaaagccaccttgccattgctgccggtactcctgcgcctcaagagatcaacattgttttactgggcaccaaaggcgggccttctttgctcaatacagccagactaccgcaagcgacggcgcttactatcggcgataaaatatggctgatagatgccggctacggcgccagtctgcaactggtgaaaaatggcattccactgcgcaacatcaatactattttgctcacccatctgcacagcgaccacatactggattatccttccttgctgatgaatgcctgggcgagtggtctgaaagaccataccatacaggtttatggcccgccgggaacccaggcgatgacgaaggctagctggaaggtctttgacagggatatcacgctacgcatggaagaagaggggaaacccgatccgcgcaacctggttaaggcgaccgatattggccagggcgtcatctataaagatgaactggtcacaataagcgcgctgaaagtgcctcattcccctttcccggacggtgaagcgtttgcttaccgttttgatacccagggtaagcgaatcgtcttctctggcgatacgtcctggtttccgccgcttgcaacgtttgcccagggggcggatatcctggtacatgaggcggtacatgtcccctcggtagcaaaactggctaatagtattggcaacggaaaaacgctggctgaagcgattgcgtcgcatcacaccacgattgaagatgtcggtaagattgctcgcgagtcccacgtgaaaaaactggtgttaagtcatctggtgcctgcgacggttgcggatgacgtctggcaacaggaagccatgaaaaattacccgggccctgtcattgtcggtcatgacaatatgacgataagcgtaccgtaggtatcagagcagggataaacccacgggctgacatgatgtcagcccgttatgcttttggcgatcagcatgacgcgcagagcttttgtctaaaacattattttttctaaacactacttgctgatttttatgcacaataaaggtaagatgattgctctggtgaaatatcactaaataagaatgtcacggatggaatttatacagtgttaaaagcaatgcgtttctttgtctgccggccatcagtaatatcctctgtaccggctcctcgttgccaaagtgaaggttagattaaacgaatcaaaaaatatccgaactgtacaatttttatatcaaacatatttaactgcaaaatactgcaaacgtgcgcgaatacacttaatcagtagtatggctaatgcatactttatttcctaaactttcttattatctatttgaatatttctggttaaaccaaatggacaaacggataccagacactcgaaaggataactgcaggcttctgatttaggattgcagttaccaggacaatggctattttctttaagcgatttccatagaacaggattaaacctggtaacgttgtaaacagtaacgggataaagtttatcgtttattaagacccccttattaaaggggatgataatgctacctggaggcatgtaaacatctgcctgataccataaggtcaatctaagattttttaggctatgtatgcatgagaacgacactccggtagagggacttataactgtatcaacgaccttccattccattacagaaaccttttaagtgaaatagtcaatggtgtaaattacattttccgcaagcctattcaggatagatgaaaatctgagaaacataactcgttgaaaacgatcgttttttattgaccactctatttatattgattttttaataagttatttattttatgctcttattttgtttacattctattacatttttgtattttaggcgtggtgtaaatattgggcggtagtggatgttataacgctcaattattaaactgtaagtgactgttgtatttcttatttataaataccgcaacctgtaagcgcagcggtacattttacccggcattgacagggagaaggtacgtatcaaccagagagtacaaaacagtgaaagaatatattcttcaggcaataaatgatcgctaacgtgtaaaaataaccgacgtatctaaaaaatgtgaacgtgtggctggtctttatttaaacgatgatcttcgcaatggcgcattaatggctgacattggcggttcgttgatcgggttgtgcgcggtgaaaggctatatttcttccgttgagggaagtatgtcagaggcattctggtattataccgggtgcatgtaaatccggggtgggcagaaagcccaccctcggtttattgcctttatcgtggattagggatgcgagataaagcgagaaaggcgttgcagcagtaaccggttttcttcgcgcagccgtgaattctcttccagcagcgttaacgcgaccgcgatcccaggccagtcgagcgccagctcctcgcgtaagcgtagcgcgcgttgtaccacgctcgctgcgcgatcgtcgaattgccagtcggcgttatcgtcttcgtaaggctcaattacgccaagtccgacgatttcgtttagctcctcttccgtcacgccggtgtgcaaacaaaattcggtgatggtaaaggtgacagtgatgttagccattatgctttcccccattgctggcgtgggtcaaaggacgactgcgcgtccgccagttgttgccacagggcagctgttttctcgtcaggtttcggcggcataacgattttgatgatggcatagagatcgccagtgtgctttttactggctaatccttttcctttgatacgcagccgctgacctgcctggctgccggggggaatggtcagcaaaatacgctctttaagcgttggcacagacaccttagcgccgagcgccgcctcccatggggcaagcggaaggacgacttccagatcctgattgacgatatcaaagagcggatgcggggcaatatggataacgagccataaatcgccattaggtccgccgttttcccccggcgtgccctggcctttcagtctgattcgttgcccgttgctgacgccagccgggattttcacattcaatgtcttgggaatttcccgctccaccaggccgaacgcgttataaacggggacggaatagctaatcgtacgctggtgctcttccagcgtttcttccaggaataccgccacttcaatttcgatatcatgaccgcgtgcggcgtggcggtgatgcgaatggcgaccgtgctgaccaaaaatagacgagaaaatatcatcaaaatcttcagcgttatacggctggccttcgtgttgctggaactggcgattaaattgtggatcgttacggtgttgccataactggtcatactcggcgcgccgttgctcatcactcagcacttcccatgcttcagcaacctctttgaaacgggcttcggcatcgggttctttgctgacatctggatggtacttgcgggccagtcggcgataggcggtcttaatcgtcttgagatcgtccgtcggtttcacgcccataatggcgtaataatccttaagttccatagcatcatctcgctaaatcaatacatacagaagggaccccaaaaggtttctccactaagtgtagggtaaacctgaaaagtgcgtatgaaaacaccagttatatcattagtaagaataaattacgttgttcgactatcagaaggttgcgcagcgcgccgacataactttacaggggaaaggttgccaaaaccgcgccagtggctaagataactcgcgttaaacagtgagggcgcaatggcgaaacaacaacggatgggctggtggtttctttgccttgcatgtgtcgtggtaatggtttgtaccgcgcaacgcatggcgggcctgcacgccttgcagatgcaggcgacggcctctgctgcggtggtcagcgctccctcctcgacagatgacggctcgccggtcaccccctgcgaattaagcgccaagtcgctgctggcggcgcctccggtactctttgaaggcgctatccttgcgctttgtctactgctttccttactggcgcctgtccgggtcatgcgcctgccgttttcgcctccacgggctatttcgccgcccacattacgggtacatctacgattttgtgtcttccgtgaatgacagaccggttattgctaacggttaattactcattcacggagaaaaaatatgatgattttgttcaggcggatactgttctgcctgttatggctttggctgcccgtctcctgggcggcggaaagcggctggctgcgttcgcccgataacgaccatgccagcatacggctacgtgccgatacgtccgctaacggtgagacccggctgttgctggatgtcaaactggaaaacggctggaaaacctactggcgcgcgccgggggaagggggcgtggcaccctctatcgcctggaaaggcgacatgcctgaggtaagctggttctggccaaccccctcgcgctttgatgtggcgaatatcaccacccagggatatcacgacgaggtgacctttccgatgatcgtgcgcggtacgctgccggcgaccttgcgcggtgtgttgacgttatcaacctgcagcaatgtttgtctgttgaccgattaccccttttccgtgacgcctactgtgcagaatgccgattttgcccatgactatgcgcgggcgatgggtaaaattccgctccgcagtggactaacggactcgcttgacgtcggctatcgcccgggagaactggtggtcactgctacgcgagcggcgggctggtcatcgcccgggctctatcttgacaccgtagatgacgtcgattttgcgaagcctcgtctgcgcgtagagggcgacaggttacaggcgacggtgccggtgacggacagttggggcgaaaaggcgcccgatttgcgcaacaaatcgctgaccctcgtgttagccgatggcgctatcgcccaggagagcacgcaaaccattggcactgcgccagcgcaaacgccggacaatgcggcgctacctttctggcaagttgtaatgatggcgctgatcggcggactgattcttaatttaatgccctgcgtactgccggttctgggcatgaagcttggctctattttattggtagaggaaaaaagccgctctcacatcaggcgacaatttttggcttcggtcgccggtatcattgcgtcatttatggcgctggcggcgtttatgaccctccttcgcctgtcaaaccatgcgctggcctggggagtccagttccagaatgtatggtttattggttttatggcgctggtgatgttgttgtttagcgccagcctgttcgggctttttgagttcaggcttccctcatctatgaccacgaaactggccacttacggcggtaacggtatgtcgggacatttctggcagggggcattcgccacgctgctggcgacgccttgtagcgcgccgtttctgggcacggcggtcgccgtggcgctcacggcgtcgctgccgacgctgtgggggctgttccttgcgcttggcctggggatgagcgcgccgtggctactggtcgcgatacgaccagggcttgcgctacgtttaccgcgccccgggcgttggatgaatgtcctgcgcaggatcctcggtctgatgatgctggggtcggctatctggctggcgacgttactcctgccgcatttcggcttcactgcgtcaaagagcgcgcaagacacggttcagtggcaaccgttgagtgaacaggcaatccagtcggcgctggcgcagcataagcgggtatttgtcgatgtcactgcggactggtgtattacctgtaaagtgaataaatacaacgtcctgcaaaaagaggatgtgcaggccgccttgcaacagccggatgttgtggcgctgcggggagactggacgctgccgtccgatgccattacagattttctgaaaacgcgcggccaggtcgccgtgccgtttaatcaggtatatggccccggcttgccggaaggggaggcactgcccactttgctgacccgcgatgcggtattacaaacgttgaaaaaagcgaaaggaataacccaatgaaatacatgattgttttactgctggcgctgttttcgacgctgagcatcgcgcaagaaaccgctccttttacgccggatcaggaaaagcagattgaaaatctgatccatgcggcgttgtttaacgatcctgccagcccgcggataggcgctaaacaccctaagctgacgctggtgaactttacggattacaactgcccgtactgcaaacagctcgatccgatgctggaaaagattgtgcagaaatatcctgacgttgcggtcattattaaaccgctgccatttaaaggagagagttccgttctggcggcgcgtattgcgctgaccacctggcgcgagcatccgcaacagttcctcgcgctacatgaaaaactcatgcaaaagcgcgtttaccatacggatgacagtattaaacaggcccagcagaaagcaggggctacgccagtgacgctggatgaaaaaagcatggaaacgatacgcactaatttgcagttggcaaggctggtcggcgtgcaaggaacgccagcgacgatcattggcgacgagctgattccgggcgcagtgccctgggatacgctggaagcggtggtgaaagaaaaactggcgtctgccaatggcgggtaaactgcggcgttggctgcgtgaagccgcggtttttctggcgctcctcatcgcgataatggtggtcatggacgtctggcgcgcgccgcaggcgcctccggcgtttgccacgacaccattacgtacgctgacgggagagtcgacaactctggcgacattgagcgaagaacgccccgtactgctctatttttgggccagctggtgcggggtatgccgctttactacgcctgcggtcgctcgcctggcggcggaaggggaaaacgtcatgaccgttgcgctccgctccggcgatgacgctgaggttgcccgctggctggcgcgcaagggcgttgacttcccggtcgtcaatgatgctaacggcgccttatccgctggctgggaaatcagcgtgacgccaacgctggtggtggtttcacaaggtcgggttgtgttcaccaccagcggctggaccagctactggggcatgaagcttcggctatggtgggcaaaaacgttctgaatatgcgccggggtttcccggcgctaacgcgtttactgtaagaaaaacccccgttttgcgaaatcgttcccggaaaaatgatccatttctgtcacactcagaacgatttgataacaacaagaggtcatagggatgaaaaaatcattactcgctgttgctgtggcaggggctgttttgttgtcatccgccgtacaggcgcagacaacgccggagggttatcaattacaacaggtgctgatgatgagccgccataatctgcgggcgccgctggcgaataatggcagcgtactggcgcagtcgacgccgaacgcctggccggcgtgggacgttcccggcgggcaactgacgacgaaaggcggcgtgctggaagtctatatgggacactacacacgtgaatggctggtcgcgcaggggctgataccgtcgggagaatgtccggcgcccgacacggtatatgcctatgcgaatagtttgcagcgcaccgtcgccaccgcgcaatttttcattaccggcgctttccccggctgtgatattcctgttcatcatcaggaaaaaatgggcactatggaccctaccttcaatccggtaattaccgatgattctgccgcgttccggcaacaagccgtacaggcgatggaaaaggcgcgtagtcagctacatcttgatgagagttataaactgcttgagcagataacgcattatcaggactcgccgtcctgcaaagagaagcatcagtgttcgctaatcgacgcgaaagataccttcagcgcgaactatcagcaagagcctggcgtgcaggggccgcttaaagtagggaactcgctggtggatgcgtttaccctgcaatattacgaagggtttccgatggatcaggtcgcctggggcgggatccacaccgatcggcagtggaaggtgctgtcaaaactgaaaaacggctatcaggacagcctgtttacctcacccacggtggcgcgcaatgtcgctgcgccgctggtgaaatatatcgataaggtgctggttgccgatcgcgttagcgcgccgaaggttaccgtgctggtggggcatgattccaatatcgcgtcgctgctgacggcgctggattttaaaccctatcagctccatgaccagtatgagagaacgccgattggcggtcagcttgtcttccaacgctggcatgacggcaacgctaaccgggatttgatgaaaatcgagtatgtctaccagagcgcccggcagttacgcaatgcggaagcgttaacgctcaaatcgcccgcgcaaagggtaaccctggaactgaaaggatgtccggtggatgcgaacggcttctgtccgctggataagttcgataacgtcatgaacactgctgcaaaatagccatatgcccccgcgcaggcgggggcgtttgtgttatacgtttttacgttcgatgatttgttcgccccagaagagcgagtctttgtccgttttctcaaaggctttgatcagcacctcatcgctaccttcttcccatattttttctgccagtttctcgtcatagtgagcgacttcaaaaatggcttcggcaatttccggcgacgtattacgcaggcttgcccattcgccgacgcggtgcgcttttgcttcttgagttggcattcgaatcctcctgttgaagattagccgttgagtttgactgccagaccggcgacgtattccccctgatagcgagcgatagagagttcctcctggcttggttgacgtgaaccgtcgcctccagcgatagtcgttgcgccgtaaggcgtgccgccgcgaacctgggagacgtcaaagagttcctgtgcggcatagcctatcgggacgatcaccatcccatgatgggcaagcgtagtccaggtcgaggtgatggtctgctcctggccgccgcccgttccggtagaactgaacacgctgccgagcttgccgtatagcgagccggatgcccacagtccaccggtttgatccaggaaggtacgcatctggcctgacatattgccaaaccgggttggcgtaccaaaaataatggcatcgtaatccgccagctcctgtggggtggcaaccggtgcgttttgcgttttaccgccagcttttgcgaagatttcaggcggcattgtttctggcacacgctttataatgacctctgcgccgtcgactttctttgccccttccgccaccgcgtgcgccatggtttcaatgtgtccgtacatggaataatagagcaccagaatctttgccatttgtactactcctcagattaatcaggtgtgtagcgattcgctacgtctatttaaagatatgctctcctgtgaagagtgcaaatttcagcgccatttctttgatttataacaataattaatttggcgacctttgttgcaaaatgatacatttttaagcgctttgattttcccaaatataagaataacttatttatttcttatggttattattctgcgtattcggcttccaatgttgcagaatatttcggtaagcggcctactacgacgtttttcactatgcttaatgttacgcggcgttactgatgatatcgttcatacgctgcgcgaggagatactcctcattacctatgcaatatgatgtctaatctatgacggaggtcagtaatggcaaaccatcgtggcggttccggtaattttgcggaagaccgcgaaagagcatcagaagcaggtcgtaaaggtggtcagcacagcgggggcaattttaagaatgacccgcagcgtgcatccgaagcaggcaaaaaagggggcaaaagcagtaaccgtaatagctagcctgcgtcacaacagcaagacgctgagcgtttcgcgctaaaaagtgtcatgcgccaccgccgccggatttccggcggtttttttgtttataagccggatttggtatgcttgcgtcctgacaaaaaggagagggcgcatgtcgcaacgcacagagaaaaaaatcgggaaacgctcgcaggccaccggtgcaaaacggcagcttatcttaaccgccgcgcttgctgttttttcccagtatggcattcatggcgcgcgtcttgagcaggtcgccgagcgggcaggcgtctccaaaaccaatctgctttattattatccctcgaaagaggcgctgtatgtcgcggtaatgcgacagattctggatgtctggctggcgccgctcaaggcgtttcgcgcagaattttcccctctggaggccatcaaagagtatatccgtctcaagctggaagtttcgcgtgattatccgcaggcgtcgcggctcttctgcatggagatgctggcgggcgcgccgctcttaatggaggaactgaccggcgatctaaaagcgttgatagatgaaaaatccgcgctgattgccggatgggtgcacagcgggaaactggcgcccatttctccgcaccatttgatcttcatgatttgggccgccacgcaacattacgccgattttgcccctcaggttgaggcggtaaccggcgcgacgcttcgcgatgaagccttttttaaccaaacggtcgaaagcgttcagcgcattattattgaagggattcgcgtgcgttaaccggctggcggcagtgggcagctcaaatccccctcttcacattgcagcagcgaggctaaaaacgcttcgcgttcgttcgttttatcggtcaggcactggctggcgatcatgggttgcacgctgccgccctccgtacctgagcgaatcagcgcgcaatcggcgtcgcgcagggcaatccatgccacctgtgctttttgtaacagctcgcgctgcggcggttgcgcacgcttaagcgcgctttgataggtttcgttcagctttttatctgccgcctggtattgcgcggcggcgcagcgattcatttccagctgcgtactggcgctggcacactcatcggccaacgcctgactgctgatcaacaacgccgcgcaggtaaggaaaattcgtttcatacggtcctctgacgcgagtaaaaaggctccattgacggagccttaattaaccacagtattagccaattgtcatcaggctggcattaccgccagcggcggcagtgtttacgctcagcgaacgttcaatatagagccgttccagcagtatattgctttcgccgcgggcgaacccctgtaccgacactatcgcgccttcgcgggcggcgacggcttcgcacacggttcgcagcttgtcggagtcgccgtggaaaatcaccgcgtcaaacggctgcgccatcagcgtttccgctttcgcaaactggacacgcgccgcgacggcggcggggagacgtttcgccagatcgcggtggaaggcgtcgtctgaccatagcgcctgactgccgacggcgagaacggcggcaagctgcgtcaacgcgtcctgttcatcatcagccaggcataatacccgttcacgcggcaacaacgtccaggtattgcgctcgccggtcggccccggtagcaggcgctgcgtgccggcctgggccagatcggcgaattgtcggcagagcgtctgtagcgccgggcgatccgccgcccattgtgtcagggcggtcaacggcgcgagtagcgtggttttaagctgcgcatccaccgggtaacgcgcatcctgacgagtcagcgtcgtattgagcgcattgggcgggcggtgtgccagcaggcggtagagatagagcggtcctcccgcttttggcccggtgccggacaggccttcgccgccaaacggctggacgccgacgaccgcgcccaccatattacggttaacgtacaggttgccgacatgggcggaaccggtgacttgcgcaatggtttcatcaatacgggtatgtacgcccagcgttagcccgtagccggaagcgttaatctgttcgataagctccgccagttggttacggttataacgcacgacgtgcagcacgggcccgaagacctctttttccagttctgcgaagttttccagctcaataagcgtgggcataacaaacgtaccggtctgccattcctgcgcatcatcgctgttttcacgtgcggcctggaaaaccgggcggcctttggcgcgcatcgtctggatgtgacgttcaatgttggctttggcctcgctatcgatcaccggcccgatatcggtcgtcagacggcctggattccccatccgacactccgccatcgcgccgcgtaacattttcagcgtatgttcggcgatatcgtcctgcaaacacagcacgcggagcgcggaacagcgttgtccggcgctgtcgaaagcggaagccagcacatccacgaccacctgctcggtgagcgcggaagagtcgacaatcatagcgttcataccgccggtttccgcaatcaacggaatagggcggccctgggcgtcaagacgcgtggcgatgttgcgctgcaacaacgtcgcgacctccgtggagccggtaaacatcacgccgcgtacacgcgcatcggcggtaagctgggcgccgacggtttctccccgtcccggcaacagttgcacgacgcccggcggtacgcccgcttccagcaaaatggcaatgccctgggcggcaatcagcgatgtctgctctgccggtttcgccagaacgctgttacctgccgccagcgcggcggcgatttggccggtgaaaatggccagcgggaagttccacggactgatgcagactaccggccctaacgggcgatgcgtttcgttatcgaaatcgtcacgcacttgaccggcataataatggaggaagtctaccgcttcgcgcacttcggcaatggcgttgctgaacgttttccccgcttcacgcaccaacaggccaatcaactgctgcatttggtcttccattaataccgccgcccgctgcaaaatagcggcgcgttcttgcggcggcgtcgcaaaccaaaccggcgcctgattgaccgcgttttgcaatgcctgttcaacctcgctttctgtcgcttcgcgtccccagccaacaatatctttcggttccgccgggttgataaccggcgtcatctcaccgtcggccaccggttgttccagcacaggtttggcctgccatttctgcatggcgttgcttaacagggcagaagaaagcgaggcgaggcgatgttcattcgctaaatcaagtccggcggagtttatccgaccttcgccgtacagatcgcgcggcagcggaattttcggatgcggtatgccagcctgaccttcctgctgcgccagtttttccacggcctcgaccgggtccgccaccagttcatcgagcggtagggtggcatcggcgatacggttgacaaaagaggtgttggcgccgttttccagcaggcgtcgtaccagataggccagcagggtttcgtgtgttcccaccggcgcgtaaatacggcagggacggttaagttttccgtccgccactttaccggtgacctgttcatacagcggttcgcccatgccgtgcaggcactggaattcgtactgacccggatagtaattttgcccggccagatgataaatcgccgccagtgtgtgagcgttatgggtcgcgaactgcgggtagatcagattagggacggcgagcagttttttcgcgcaggccagataagagacatcggtatacactttgcgggtataaaccggatagccctccagcccttccatttgcgcgcgtttgatctcgctatcccagtaggcgcctttcaccagacgaatcatcagccgacggcggctacgggaggccagatcgactaaataatcaatgaccagcgggcagcgtttctggtaagcctgaatcacaaagccaatgccgttccagcccgccagttcgggttcgaagcagagtttttccagcagatcgagcgagatctccagacgatccgcctcttcggcgtcgatattgagaccaatgtcgtactggcgcgccagcagcgtcagggatttcaggcgcggataaagctcctccattacccgatcgtattgcgcgcgactatagcgtggatgcagggcggacagcttaatcgagatgcctggcccttcgtaaataccgcgaccgttagacgctttgccgatggcatgaatcgcttgctggtaagaaaccatataggcctgcgcatcggcggcggttaacgcggcttcgcccagcatatcgtaagaatagcggaaccctttctcttccagttttcgggcattcgccagcgcctgagcaatggtttcgccagtcacgaactgctcgcccattaaacgcatcgccatgtcgacgcctttgcggattaacggctcgccgctcttgccgataatgcggttcagcgagcgcgatagattggcttcgttatgcgttgagaccagtcggccggtaaagagcagcccccaggtggcggcgtttacaaacagcgacgggctacggccaatatgcgactgccagttgccattactgattttgtcgcgaattaacgcatcgcgcgtagctttgtcgggaatacgcagcagcgcttccgccagacacatcagcgctacgccttcttgcgaagagagggaaaactcctgcaacaggccttgcaccatacccgcgcgaccgctggcggatttttgattgcgcaatttctccgccagttgatacgccagtttatgcgcctgctcagcgacaggcggcgacaggcgcgcctgttccattagcattgacaccgcatcggtttccgggcggcgccaggcggcggtgatggcggcgcgagagacggattggggaagaatttgttcggcaaactccagaaagggctgatgcggctcatcctgcggcgcgaccggctcctcgctttcatttgccgcgccgacaaacagcgcaggtagctccggtagcgtatcgctattttccagcttgtccagatagctaaagattgcctgttttattaaccagtgcggcgtgcgatcgatacgcgacgcggccattttgatccgttcgcgcgtggcgtcgtccagcttaacccccatcgtggtggttcccataccctctactcctgttattcgctctatctgctaaccaatagttagcggaaaatatccaccatgttgcaactttgtgcaaccgcgttaaatgtgacctgcgttgcaagcttaaaaatgaatgaattgttaaaaaaagataagggagtgtctgacgagaaaaccatctggatttattttctctgcggtagttaacacttttaaaaggtgcaaccgcaaaaaatgtgagagagtgcaacctggagaaaaatagtatccctctgcaatcaaatttgatgtaaatggtgtgttaaatcgattgtgaataaccaccgcttccggcaggatacggtcgccctggtaaacataacacccttgccacgttccggcagggtacaaaacggcacgctacggtagtgccaataaataaatttggagaaccttgatggctattagcacaccgatgttggtgacattctgtgtctatatttttggcatgatattgattgggtttatcgcctggcgctcaaccaaaaactttgatgactatattcttggcggtcgcagtctggggccgtttgttacggctttatcagccggcgcgtcggatatgagcggctggctgttaatggggctgcctggcgctatctttctgtcggggatctctgaaagctggatcgccattggcctgacgttaggcgcatggattaactggaagctggtggccgggcgcctgcgcgtgcataccgaatttaacaataacgcgctcacgctgccggactattttaccggtcggtttgaggataagagccgagtcctgcgtattatttccgcgctggtcattctgttgtttttcactatctattgcgcgtcaggtattgtcgctggggcacgactgttcgaaagcaccttcggtatgagctatgaaaccgcactgtgggcgggggccgcggcaaccattatttatacctttatcggcgggttccttgccgttagctggacggataccgttcaggccagcctgatgatttttgcgttaatcctgacgccggtgatggttattgttggcgtaggcggtttcagcgagtcgctggaggtgatcaagcaaaagagcatcgagaatgtcgacatgctcaaggggctgaattttgtcgctattatttccctgatgggctggggactgggttacttcggtcagccgcatatcctggcgcgctttatggcggcggactcccatcacagcattgttcatgcgcgtcgtatcagtatgacctggatgattctgtgtctggcgggcgcggtggcggtgggcttctttggcattgcgtactttaacaataaccccgcgctggccggggcggtgaaccaaaactcagaacgcgtatttattgaactggcgcagatcctgtttaacccgtggattgccggtgttctgctgtctgctatcctggcggcggtgatgtcgacgttgagctgtcagttgctggtatgctccagcgcgattacagaagatttatataaggcttttctgcgtaaaagcgccagccagcaagagctggtatgggtagggcgagtgatggtgctggtggtagcgctgatcgccattgcgctggcggcgaatcccgataaccgtgtgctggggctggtgagctacgcctgggctggattcggcgcggcatttggacctgttgtcctgttttctgtgatgtggtcgcgtatgacacgtaacggcgcgctggcgggaatgattattggcgcggtgacggttatcgtctggaaacaatatggctggctggatctgtatgagattatccctggcttcattttcggcagcctggggatcgtaatctttagcctgcttggcaaagcgccgacagcagcgatgcaggaacgctttgcaaaagcggacgcgcattatcattccgcgccgccgtcgaagctacaggcggaataaccgacatgtccgatagcattattgccatcggacatattttaccaggcggcgttatacgcccgcctggtcctctgataagtcccggaccgattgactgaagatgttcaggtaaatgaggacgcactctcaaactatttttagcccttgagcgccgttaacgcgggcgtaatacatctcgagtaatcactaactagccatatatgaaatcgcctgttaatggtaccaatagccttgacgcaatagagtaatgacaaaaattaaaacaagtcagcgttactggcgtaagtatgccgcataaaattttgcataaataatgccgttttagcgatgggagagaggacacgttaattattccattttaaccttatatatgttcaatattcaatgggttatggatgttttcagcattaatacccgcagtagctaatgattatcttttttagtctcctgccgatgaaataatcgtgtaatctttctgtaagagactgacaatgacgcaataatgtttggttaatgcttggtgaatatattgttgcattattgatgttttgtgttgtacttagtagtaatagcggtagttccccggcagtgatggtcactcactatggagatcgcgaatggtaatgtccgcaccaggacacattgtttacagtagttacaacaccctgtacggacattctctctccggtggtggtcttgtcatcttaaaagctctcatcatttcccttactgaccatacccatgacgtcatatgtggtgcgcgtagccgtgtgtggcgtcgtttcaaaaagcaagctaaggcttacaaggaagccaaccctcagatgtgtgtgcgcataatcgcgttcaagagaacgcgggtgatgtatacctacaactcaaggtgctatccatgggaagacaaaaagcagtgatcaaagctcgtcgtgaagcaaagcgtgtgttgagacgagattcgcgtagtcataagcaacgtgaagaagaatcggtcacgtcactggtacagatgggcggagtagaagccattggcatggcgcgcgatagtcgcgatacctctcctgttaaggcgcgaaatgaagcacaggcgcattatctgaacgctatcgacagtaaacagcttatttttgcgaccggcgaagccggctgcgggaaaacatggatcagtgcggcaaaggcggcagaagcattgattcataaggacgtcgagaggatcattgtgacgcgtccggtattgcaagctgatgaagaccttggttttttgcccggtgatatcgctgaaaaattcgcgccttattttcgtcccgtctacgatgtcctgcttaaacggttgggcgcgtcctttatgcaatattgtttgcgcccggaaatcggtaaggtagaaattgccccgttcgcctatatgcgtgggcgtacttttgaaaatgcggtcgtgatcctcgatgaggcgcaaaatgtgactgcggcgcaaatgaaaatgtttttgacgcgattaggcgaaaatgtcacggtcattgtcaatggcgatattacgcaatgcgacctgccgcgcggcgtgcgttccgggttgagcgatgcgttggaacgctttgaagaagatgaaatggtagggattgtgcatttcaacaaagacgactgcgtgcgctcggcgctttgtcagcgaacgcttcacgcatacagctaatatagcattgactttcagagcccgggaaaccgggctttgttatctataaagcatccagcagactcatggacaaaaaaggaaaatgacgcctgtacgtgaagggaattattttgtcatgtccagggcattcattgtccgtaatttgctttctcgggcctgttccggcgaggactgtacaagaagggtatagagcaggtcaaagacgaaaagctgcgcggctttcgtaccgatcgagtcaccctgcaacattccttgccgattaccattgatcaggcaaaaatcggcctcttcacataatggagaacccagattatgggtaatggcgactgtggtggcgccagcctgtcgggccaatcggagtgaatgcactgtttctggcgatgtgcccgagtgactgacacccatcgcgacatcgcctgcttttaatagcgtagcctgcatgtacataaaatggttattgcttaccgcatcgccccgtaaaccaatacgcattagcttgtgtttcatatccagcgccgtgatccccgatgagcccacaccaaagatataaactgagtgacagtgacgtagggcatccacgacaccgagaacctgttgcatatcaagcagatttagcgtttcagataatacattactaatggtgttctgcaattttaaaccaatggcgtgggcatcgtcggattcgctaacttcggcatccagtagaggactactgtcatcagactcggtagtggcaagttcaatggccaggtccattttaaaatcctgaaaacctttatagcccagggtgcgacaaaagcgaataaccgtggcttctccggcctgtgtttcgcgcgacaaatcggcaatagatgactgtgtcacctgtctggggaaggctaaaatatattgcgcaatacgctgggaggcacgtgtcaggcttttttgcatagcacccagagtatcaaggatttttccgggtttaagacgtgggggttgaggctccatatagttcctgctcttgagggctgattgcggcacaaagcctgcaatatcgaacagagcagagcctatcaagtctgcggcatgaaaaaaagcgcgatgtaagtaaaggagggggaatatttacatcgcgttgccaacttatgacagaacatcactggagagtaatctgttgctcttacggtgtttatagcgcgccatttgacggatggtttatacctggcccggtattgtcgccccgcgcgttggcgtcaccgtatgctgtgtcggtatagcgtggtatcatgaaatcataatgtcacctttggttcaggtttttcatccagcgtcaatggcggtgccggggcaaataacggggcgaaaataacgccgctgatcaccacgcttagcgagccaatgaccccataaaagaagaagttaaggtcagtggcatagcgtgcgcccagcacggtaatgacgctgataataattcctaaaaccgcactcccggcatttgctcgtttaaagaaaatgcccagcatgaacagaccggtcattggccctcccatcagacctatcagactattaaatgcatcccagatttctgattcatcggccatgaccagccataccgaggccgcgctacttatcaagcccgcgaccagaataactaacttagctattttcatacggttttctggcgttctttttttatgactcaaacgctgatagatatcggaattaaaacaactggaaatgctgtttaagctgctggagatactggactgcgcagcagcgaaaatagcggcgattatcaaccctgcaatgccgactggcatttcggtgaccacgaataagggcaaaatgccgccagtgttgaatcccgccggtaataattgtggatgttgctgataatagacaaacaatgccgagccgatagcaaaaaagaaaacagggatcacagcaaccagtttggcatttgtaagtaatgttttcttcgtttcctctatggagtcagtcacgatatagcgttggaccacatcctgactggcagtaaattgctgaatattggcaaacagaaaaccaatcatcaatacaggtactgtgctttccgtccagctccagtggaactgcgtagccggaaagaatttatccgcctgctgcgtcaccgtaaaaatttcatcaatgccgccctggactttgagacatatcactataaaaatcagtatcgcgctgccagaaagtaagaggccttgaataacatcagtccatattactccttcaattccacccatccaggtataaatgatacacatcacgctaatcaacagtaccaaaatcaccgggtctatagcgatgaaggggcgcaaggccagcacggtgaggaaagtgataatggcgatacgtccaatatgaaacaacataaatgacatgctggcgaacagacggcagcgcacatcgaaccgtgcttcgagatattcataggctgatgtgactttcaatttccgaaaaaacggaatatagaaataaaaaaccagcggtaaaattgcgatagccagatactgaccaatgataaacgtccagtcggaagtaaacgctttggcaggaattgacataaatgtaattgagcttaacgtagtagcaaatacactgaccccagccgcccaaccaggaacccggccaccaccgcgaaaataatcgtctgctgttttttgccgtctggaaaaatagacaccgactaacatcatggccaggaggtagccaaataatacaagataattaacgatgccgaaagaatgtgtaatcatagttctttcctgcttatggttttgagtagagttgcggtcatcgtctgtgtatttttatcttcccatcattcagacgatacgatattcagatcaagtaatagtttttgttaatctcaatgacggtaatcatgagatgtaaaaggcagagcatttatgctccaccaatggtgatgcccagacgtatgtcctgccggatacctgaaatagcagatatccgatattgcgttcaaacaggcttcaggcctgggtctcgtatttgccgatagcattattaacgtcggattattctctgaggcataaatatcaatagtaagcgtgttcattttcttttcctgttcagcgttttactgcgtgactgaaccactgacagatatgctcaatacgggtgatagcggaaccaacggtaactgcccaggcaccatgctcaatagcattggccgccagtgcaggcgtgttatagcgcccctcggcaataacacgacaacctgcatggctcagttgtgtcaccattgccaaatctggctcaaccggcgtgatggggccggtatagccagacagtgttgtaccaatgaattcgattcctttctgatggcaacttatgccttcattcacggttgaacagtctgccatcgccagtaatccatgcaggcgaatacgtgtcagtaaactatcaatatcaaccgggcgagagcggaatgaggcatcaaaagcgataatatcggcacctgcctgcgccagggcgtcaacatcctgtaaatatggagtgatacggactggcgaccctgtaaggtcacgtttaattatcccaataataggaacagaaagatggggacgaacagtccgcagattctcaatgccttcaatgcgcacagcgaccgcacccgccgaagccgctgcctgtgccattgcagccacaatttcaggtttatccatagggctgcctggtaccggttggcatgagacaatcagcccaccgttttcgtgtacactttgttccagcctggctaatagtgacatccagttccgccttatatatttgaagttttgctccgttttatgttatgtcttggagtgttgctacatcaagcaaaaagatagaaaaatgtgaacacagtcataaggtatgtttgttattcaattactgcgccagcggatttgaggctataacctgaagctacaagacaaatacaattcattctgacggcagcatgctgtattttattaactgcttccggcataaagataaaatgctcagaaggagcttatacgccacgggatagccagtatgaaatgcatcacataattcttgttgtatttattcagaatgctatcactaatgagtttggccataacagatcacccataatcacttctaacatcaccatggggtgcttttacctcgcacatgataactccatgtaattatttttagcgcttggtcacattttgtcattgtcattgttgaaattgtgcaccataagatcactaatgatgaagctttactccaattgtatttcttcgcatggggatgcagatgaaaaattttaagaaaatgatgacgctaatggcgctatgtttctcagttgctatcaccacatcaggatatgcaacgacgcttcctgatataccagaaccactgaaaaatggtactggcgctattgataataatggcgtgatttatgtcggcttaggtaccgcagggacatcctggtataaaattgatcttaaaaagcaacataaagactgggagcgtataaagtcgtttcctggtggagctcgtgagcaatccgtgtcggtatttttaaatgatgagctttatgtttttggtggcgtagggaaaaaaaacagtgaatcaccgttgcaggtttatagcgatgtgtacaaatactcaccggtgaaaaatacatggcaaaaagttgacactatatctccagttggattaacagggcatacgggagtaaaattaaatgaaacgatggtacttattaccggaggggttaatgagcatatctttgataagtattttattgatatagcggctgcggctgcggatgaaagtgaaaaaaataaagtcatctataattattttaataaacctgccaaagattatttttttaataaaatcgtatttatctacaatgctaaagagaacacatggaagaatgccggtgagctgccaggcgcggggacggcaggatcgtcatcggtaatgggaaataatttcctgatgctgattaatggtgagctcaaaccgggtttacgtaccgatgtgatttaccgcgccatgtgggataacgataagctaacatggttgaagaacagccagttaccgccatcgcctggagaacaacagcaggaagggttggccggagcattttcgggctatagtcacggtgtcctgcttgtcggtggtggcgcgaattttccgggagcaaaacaaaattatactaatggaaagttttattcccacgaagggataaataaaaaatggcgagatgaagtctatggtttgattaatggtcattggcaatatatgggtaaaatgaaacaacctctcggctatggtgtatcagtaagttatggtgatgaagttttccttattggtggtgaaaatgctaaagggaaacctgtttcgtctgtaacctcctttaccatgcgtgatggtaatttattaataaaataattttttaaatacaaaaataaagttaattgatgagcggagtattttatgaaaatcaacaaatatcttctgggtatggtttcgtttatagcattttcatcatatctacaagcggcaacccttgattatcggcatgaatatgctgatagaaccagaattaataaagaccgtattgctataattgaaaagcttcctaacggcattggtttttatgtcgatgccagcgttaaatcgggaggagtagatggtgagcaggataagcatttaagcgatctcgtcgcaaacgctatagaactgggcgtaagttataattataaagttacggacaattttgttttgcagcctggatttatatttgaaagcggtccagacacttcaatttataagccttatttaagggggcaatataattttgattctggtgtttatatggctggtcgttaccgttatgactatgcaaggaagacagctaactatagtgatgatgagaaaacgaatagatttgatacttatataggttatgtttttgatgagttgaaattagaatataactttacctggatggatagcgatcaaattaaatttgataacaaaaaaacaaactatgaacataatgtggctttagcctggaaactgaataagtcatttacaccatacgttgaggtcggaaatgtagcggtgagaaataataccgatgagagacagacccgttatcgcgttggattacaataccacttttgagaaaggttaaagagttactgtactaatctttgcttagtattcatatcgataatcttatagcccgtagctacgttacagaacgttagactttgtcttgagtattcacgtccttaacgtagctacgaacaaggatgataaacaatgaatatacgccttacatagctacgatctcaggcggttgtcggaaagtgccgattgatagtgtcttattcggcaattgatatgacttaaaaattaattccgtaagcatttcagacggtaacagcaaataagggttttattgtgatagcaaaattcttcccgtggtatagcgagataactcgtccacaaaaaaatgctttattttcagcatggctgggttacgtttttgacggcttcgactttatgctgattttctacattatgtatctgatcaaggctgacttaggattgacagatatggagggcgcattccttgccacagcggcctttattgggcgaccatttggcggggcgctatttggtctgctggcagacaaatttggccgtaagccgttgatgatgtggtcgatagttgcctattctgtaggtacagggttaagtggcctggcttccggtgtaattatgctgacgcttagtcgcttcattgtcggtatggggatggcgggggagtatgcttgcgcttctacttatgccgtggaaagttggccaaagcatttaaaatctaaagcgagcgcatttctggtttcaggtttcggtattggtaacatcatagcagcctattttatgccgtcatttgccgaagcgtatggttggcgtgctgctttttttgtcggtttgctacccgttcttttagtaatctacatccgggccagggctcctgaatctaaagagtgggaagaagctaaactcagtggtcccggaaagcattcacaaagtgcctggtcagttttctctttgtcaatgaaagggctatttaatcgagctcaatttccactgacattatgtgtatttattgttctgttctctattttcggcgcaaactggccgatctttggtctactgcctacatatttgacgggagagggctttgatacgggcgtggtctctaatttaatgacggcggcggcattcggcactgtattgggaaatatcgtttggggtctgtgcgcagatagaattggtttgaagaaaacgttcagcattggtcttctcatgtcctttttattcattttcccgttattcagaattccgcaagataattatttactgctgggcgcatgtttattcggtttaatggcgactaacgtaggtgttggcgggttggttcccaaatttctctacgactactttcctcttgaggttcgtggtttgggtaccgggctgatttataatcttgctgcgacatcaggcacattcaattcaatggcggcgacctggcttggaataacaatggggctaggcgctgcgctaacgttcattgttgctttctggaccgcaacaattctactcattattggcctatccattccggatagactaaaagcacgtcgtgaaagttttcaatcaacaaaagaattttaatagaggataaatgatgacgaaatacggtgttgtaggtacaggttattttggcgctgaactggcgcgatttatgtctaaggttgaaggggcgaaaatcactgcgatttacgatccggtaaatgcggctccgatagcgaaagagttgaactgtgtcgccactgcaacgatggaggcgctttgttcccatcctgatgtggattgcgtaattattgcttcaccaaattacttacataaagcgccagtcattgcggcggctaaagcgggtaaacacgtgttttgtgaaaaacctatcgccttaaattaccaggattgtaaggatatggttgatgcctgcaaagaagctggtgttacctttatggcgggtcacgttatgaacttttttcacggggttcgccacgctaaagcgctcatcaaagctggtgaaattggtgaagttacacaagttcacactaaacgtaatggttttgaagacgtgcaggatgagatctcatggaagaagattcgcgcaaagtcaggtgggcatctgtatcatcacattcacgagctagattgtacactgttcatcatggatgaaaccccatccctggtttcaatggcggcggggaatgttgcgcacaaaggtgaaaaatttggtgatgaagatgatgttgtcctaatcacccttgagtttgaaagcggtcgtttcgcgacacttcagtggggatcatcgttccactaccctgagcactatgtattaattgagggcacgacaggtgcaattctcattgatatgcaaaacacggctggttatctaataaaagcgggcaaaaaaacacactttcttgtgcatgaaagccaggcggaggatgatgatcgtcgcaacggtaacatatccagcgagatggatggcgcaatcgcttatggtaaacccggtaaacgtacgccgatgtggctctcatcaattatgaaactggagatgcagtacttgcatgatgtgataaacggtctggagccaggcgaggagtttgctaaattgctaacgggagaagcggcgacaaatgccattgctaccgctgatgctgcgacgctttcctcaaacgaggggcgcaaagtaaaactcactgaaattcttggctaaaattgaaagccggatggtggtgttattggccggtggcgctgcgcttatgtagaccggataaggcgcccgtgaactgtgccgccatccggcaatggacggggcacatataagcaaaaagcccgtacttctgtacaggctctcaacttaaatatggcggtgagggggggattgactcgctgcgctcgcccttcgggcagtctcctcgcaagctcgtcgtctgtccaactggctgcgccagttgtcgaaccccggtcggtggttctcatccccccttggtttgggggatacatataagcaaaaagcccttacttctgtacaggctctcaacttgaatatggcggtgagggggggattgactcgctgcgctcgcccttcgggcagtctcctcgcaagctcgtcgtctgtccaactggctgcgccagttgtcgaaccccggtcggtggttctcatccccccttggtttgggggatacatataagcaaaaagcccttacttctgtacaggctctcaacttgaatatggcggtgagggggggattgactcgctgcgctcgcccttcgggcagtctcctcgcaagctcgtcgtctgtccaactggctgcgccagttgtcgaaccccggtcggtggttctcatccccccttagtttgggggatacatataagcaaaaagcccgtacttctgtacaggctctcaacttaaatatggcggtgagggggggattcgaacccccgatacgttgccgtatacacactttccaggcgtgctccttcagccactcggacacctcaccaaattgtcgctccagcattactggaacgggcgctaatgtagggaaatatccattctacgtcaatcaacttttttcaaaaaaaagcgcgtttatacaaacttccaccaatctgtggttttaataagcgaaaactgctttttttgcccgcgccgggaaatttgctatgctgcacatcccgttgaaaacgctgataacaggcgcaatcacattccgcacaatactgctcaggagataacatggagataattttttatcacccgacatttaacgccgcctggtgggtaaatgcgctggagaaggctctcccacatgcgcgcgttcgtgaatggaaggtcggtgataacaaccccgcagactatgcgcttgtatggcagcccccggttgaaatgctggccggaagacgcttaaaagccgtctttgtgctgggcgcgggggtggatgcaattctgagtaaattaaatgcgcatccggaaatgctggacgcctccattcctctattccgtctggaagataccggaatgggcctgcaaatgcaggagtatgccgtcagccaggtattacactggttccgtcgtttcgatgattatcaggcgctgaaaaatcaggcgctatggaaaccgttgccggaatatacccgcgaagagtttagcgtcggtatcatgggcgcaggggtactgggcgcaaaagtggcagaaagtctacaggcgtgggggttcccgttacgttgctggagtcgtagccgcaaatcctggcctggcgtggaaagttatgtagggcgtgaagagctgcgcgctttcctgaaccagacgcgggtgctgattaatctgctgccgaatacggcccaaacggtaggaattattaatagcgaattgttggatcaattgccggatggcgcttacgtgctgaatctcgcgcgcggcgttcatgttcaggaggcggatctgctggctgcgcttgatagcggtaagctaaaaggcgcgatgttggatgtctttagccaggaaccgttaccgcaggaaagtccattatggcgccatccgcgagtcgccatgacgccgcacattgcggcagtcacccgtccggcggaagccatcgattatattagccgcaccattacccagctggagaagggagagccggtgacggggcaggtggatcgggcgagaggatattgatacaacccggcgcgggccgggtttcgctaaaaaacgctggcgatacctgctatccttgtcggaaatgactacaggagagagcaatgtatcccgttgacctgcatatgcataccgtcgccagcactcatgcctacagtactctgagcgattatatcgcggaagccaaacgcaaaggcattaaactttttgcgattaccgatcatggtccggacatggaagatgcgccgcatcactggcattttattaacatgcgcatctggccgcgtctggttgacggcgtggggatactgcgtggcattgaggcgaatatcaagaatattaacggtgaaattgattgttccggaaagatgttcgactcgctggatctgattatcgcaggctttcatgagcccgtttttgcgccgcatgataaagaaaccaatactcaggcgatgatcgcgaccatcgccagcggcaaggtgcatataattagtcaccccggaaatccaaagtatccagtggaggttaaagccatcgcgcaggcggcggcgaaacaccatgtagcgctggaaatcaacaactcttcttttctgcattcgcgtaaaggaagcgaagataattgccgcgcggtcgctgccgccgtacgcgatgcgggaggctgggtagcgttaggctctgattcccatacggcctttacgcttggcgatttcaccgaatgccggaaaattctggatgcggtgaattttccggaagatcgaatcctgaacgtctcgccgcagcgcttactggcctttctcgaatcacgcggtatggcgcctgtaccggaatttgccgaactttaatcgttatttacgggaagatatcaatgaatgagttttcaatcctgtgccgtgtgctgggatcgttgttttaccgccaaccgcaagatcctttactggttccgctgtttacgttaatccgtgaaggtaaactggcggcaaactggccgctggagcaggatgacatgctggcgcgtttacagaaaagctgcgatatcacgcagatttccactgattacaatgcgttatttgttggggaagagtgcgcggtagcgccataccgcagtgcgtgggtcgaaggcgcggaagagtctgaggtgcgcgcttttttaacgtcgcgagggatgccgctggccgatacgcctgccgatcacattggcactttattgctcgcggcctcctggctggaagatcagtctgccgaagatgaaagtgaagcgctggaaaccttatttgccgattatctgcttccctggtgcaataccttcctcggtaaagttgaagcccatgccgttacgccattctggcgcactctggcgccgctaacgcgtgatgcgataggggccatgtgggatgaacttcaggaagaagatgaagaataatgtgatgtaaatcacccttaactgcaacgggttttacatcattgcataaaatgtgtgcgtgatctcattaatgtgccgcttttctgttatgatgcgcgccatgaacatacttctttctattgctatcacgacgggcatcctttctggaatatggggatggggggctgtctccctggggttactaagctgggccggttttttaggctgtacggcttatttcgcctgtccgcagggcggctttaagggattgttgatttccgcctgtacgctgttaagcggtatggtgtgggcgctggtcattattcacggtagcgcgttggcgccgcatctggaaattgtcagttacgtgttgacggggatcgtggcattcctgatgtgtatccaggcaaagcagctattgctttcttttgttccgggaacatttatcggcgcctgcgcgacatttgcagggcagggtgactggcggttggtattaccgtcgctggcgctggggctaatctttggctatgccatgaaaaatagtgggctatggctggcatcacgccgcgagcaacattcagcgaatacggcggtcacaaaataaaaaagcgtggggttcttccccacgctttgtcgtattcatcaggattctggcggtactgacagctcacggtatttcaccagaatatcattttgcctgtccgctttattctgcaaatcccacagtccgcgatcgataccatcattaatgaggaagataacgccggtttcaatggctgacatcagacacagcatcaccggttcgttcgaggtatagccgatttcgccttccagtaagcgctggtaatcaataaaacggaacacgcctgcctgtacttcataggaaaggatcgttttactggtgttcaccgaggaaaggatctcgcccgtactgacgttaaccacgcgcaggttgacagcaatctgatccagctgatactgcgtatcggcgccaataccgaaatatcttgcgccgaccccgccggatttgacgttactttcataaccaataatagaaccttccaccataatatttgccgccgtcagcgactgaagcgggatacggttattcatcgccacggtgccgttttcctgggctgcgcgaataattttccgttcattcaaaagattctgtaagccttgtcgttccagcgggataaaccagcgcgaatctttcagcgcagtgaccaacatagcggtggcgctctgcggcacagccgtagaaaagttacttgccgggtaaggtttaaattggcccgtttcatcctgaatgttatataccgaaacaaagatcttaccggtgggagcaggtaagtgcgtcaaatctttgtaactttgtgcgcggggcattaatgtcggtttcgcagcttgtttcggcggggcagttaagcatccgctcaacaataaaacggcaaccaaaataagtaagcgcggcatgatttatatcctttagtgactgtagcttaaaaatcggttgactgagtttgtaaacctgacacttcgatggtcgaggttcttcccgtttttctgtccgtgacgttgagctggagctgtccgtcgcgattagcgatatcgataataaaatcgttggtcaccatacgtcctggtttcccggtattaatattggtcaacaagccgcccagaatttgcgattgaatagcctgcgtaaagttatccaacgctgagggggtttcgataccaaaatcgttatcataagcggggtctttatatgaattttgcgcctgggcgctattcaataaaaaggaaccgttattggggtttccaccaaagttaggattacggaactggaacgtcatatttccagcccaggttaatggcgaaaaaagcatgagcagcactactgcatgtttaacacgcatgacagcctccggataaaaatcatgttttagaattcatcacgcgctaaatcactcgtacttaatagcgtttgatctatttgtcggcgatttaatgcttcctctgtttgcgctaatgcgaagacgacggttttctcgaagtctcttttcattggaaataaaaaggtctggaaaataacgtcctgatttaccgttatggtgatccagcttccccaacgcgcactgggtctttcattaatggtcagattgccggtgtattcgctttcccatttgtcgctgaatgcacgatagaattcatgtcctatcgaagagacggtatggtcggttaacaatccgggaacctcgacttcaacttcattggcatgcaggtttccggtagcgaacagtaactctgctgctacaatccaggtcagatagcgtttcatggccttaccgcctgagattatcgtttgcccatgaaactgcctgggtgcgatttttgacagctatctttttgaaaagattataaagatgtgtcttaaccgtattctcgctgataaatagcgacctcgcgatttcattattagaggcaccaatacgtaacttattgaggatctctttttcgcgatgagtgagtaatgcggactcggtgctgttgtagcggtaatttcctgagtgcgtaatcaggtaactggctaatttttgtgaaaaatagcattcgccacgcagaataccctgtaatccgctgaccacgtgttcctggtcttcagtagcgtaaaacacgccgttaatatgaggccagttttcaatttcacggtagggataatcgtcaggggtatttaacaataatgtttttatattattgtttttgcggcttaaattatcctgccaatagtggataagcttcttatccgcttccatcatatccattaaaacaatgcaaccggccgagatatcttccagagaacgttgaatattatgcagttttccggttatggccagcgattgctttaaatgttgcaataatgccgtagcttgcagagatggctttgtgatcaacaatagtgtgtgaccatgactactatggacttcattaaacatgatgaaactccactttttttaatcgcacatctgacagctgcccccataaaataaaggcaccagaagtactgacagatgttgcactgctgtgggttgaaatagcccattatccagaaagagaaaaatatttacgaaaatacttttaactgttttcaatctagccattacaaatcttaaagcaagtgttaaacttgtaaccaaatgtaaaaatatatattaaaatgttgtttttgggtttttttgaagtttagatttgatagtaaagttgtacatttcgctgttattgcatagatttaaaaaatcatacaaattataataattcattgatttttaatcattttaattattatatgttatgttttgattttattttttcttaaaatttgagacgtggcattaacctggacagcacaaagacaaaaaaaacgaagtgtgtcacgtcttgtgcgtattgccccacatgggaagcataagaacatccccatggcggcataacacacaccaacacttcattttttaggtgcgcgatacactatcttctgtggccaaaaatcaattataaaaaatcacatggctatcgttttattagcactttggtatgagcttaaataacaaaataccacgcgtgggtgagttattaaaaatgtttccacggacatactcttcatcgtaacgacgcgttaacaaaaaacgcatgtcgctaacaaggtaatagataattttcgctatgtacgaccaggtccagggtgacagcatgaaaaacaaattgttatttatgatgttgacaatactgggtgcgcctgggattgcaaccgcgacaaattatgatctggctcgttcagagtataattttgcggtaaatgaattaagcaagtcttcatttaatcaggcggccattattggtcaagtcggcacggataatagtgccagagtacgccaggaaggatcaaaactattgtccgttatttcacaagaaggaggaaataatcgggcgaaagtcgaccaggcagggaattataactttgcgtatattgagcaaacgggcaatgccaacgatgccagtatatcgcaaagcgcttacggtaatagtgcggctattatccagaaaggttctggaaataaggccaatattacccagtacggtacgcagaaaacagcagttgtagtgcagaaacagtcgcatatggctattcgcgtcacccaacgctaataccgttacgacttttaaatcaatccgatgggggttttaccatgaaacttttaaaagtggcagcattcgcagcaatcgtagtttctggcagtgctctggctggcgtcgttccacaatggggcggcggcggtaatcataacggcggcggcaatagttccggcccggattccacgttgagcatttatcagtacggttccgctaacgctgcgcttgctctgcaaagcgatgcccgtaaatctgaaacgaccattacccagagcggttatggtaacggcgccgatgtaggccagggtgcggataacagtactattgaactgactcagaatggtttcagaaacaatgccaccatcgaccagtggaacgctaaaaactccgatattactgtcggtcaatacggcggtaataacgccgcgctggttaatcagaccgcatctgattccagcgtaatggtgcgtcaggttggttttggcaacaacgccacggctaaccagtattaatttagcgtctgcgctaataaaaaaacagggcataagccctgttttttttcgggaggaaattatgcatactttattgctccttgccgcactttcaaatcagattacgtttaccacgactcagcaaggcgatatttacacggtgatccctcaggtcacattaaacgaaccctgcgtctgtcaggtgcaaattctctctgtgcgcgacggcgtcgggggacaaagccatacacagcaaaaacaaacgctatctttacctgctaatcaaccgattgagttgtctcgtcttagtgtaaatatatcttcagaggactcggttaaaattattgttactgtttcggacggacaatcactgcatttatcacaacaatggccgccttctgcacagtagtttttgatggtggcggaaatggattggctgacctgggtataaagaggcgataaaagcgtctcatcgtctcggcatgtcgctataaggtaacgccgaaccctcgaggatgactaatcattgaggagttaacatgtccgtaatcaagaaaaatatccctgccataggcctgtgtatctgcgctttttttatccattctgcggtagggcaacaaacggtacagggcggcgttatccattttcgcggcgcgattgttgagccactgtgcgatatttctactcacgccgaaaatattgatttaacctgcctacgcgaaggtaaaaagcaaatgcaccggattgaccttcggcaggcatctggattaccgcaggatattcagtccattgcgacggtacggctgcattatctcgatgcgcaaaaaagcctggcggtgatgaatattgagtaccgttaacggcggtgtcatagatataaaaagagcgactctgttgaaagccctgctgtacactttgcagataaggtgagacaaaggggggggggttatgacatcacgtcttcaggtcatacagggtgatatcactcaacttagcgtcgatgcgattgtgaatgccgctaacgcatcattaatgggcggcggtggcgtagacggcgcgattcatcgcgcggcggggccggcattgctggacgcctgtaaactcatccgtcagcaacagggcgaatgtcagacgggacatgcggttatcacgcctgctggcaagctttcggcaaaggcggttattcacacagtggggcccgtctggcgaggcggcgaacaccaggaagctgagctactcgaagaggcataccggaattgtttgctgcttgccgaggcgaatcactttcgttccatcgcttttccggcaatcagtaccggcgtttatggctatccacgcgcccaggccgctgaagtcgccgtcaggacggtttcagattttattacccgttacgctctgcctgaacaggtatactttgtctgttatgatgaagaaactgcccggctttacgcaagattacttactcagcaaggcgacgaccctgcctgataaaacacgcctggagcgtgccgttgaaccgctatgcgcgcgccatcccggagagtgcggcattctcgcgctggataacagtctggacgcttttgccgcccgctaccgcctgaccgaaatggcggcgcggacgctggatgtgcagtattatatttgggaagacgatatgtccgggcggctgctcttttcggtactgctgtcggcggcgaagcgcggcgttcatgttcgtctgctgctggatgataacaatacgcctggtctggatgatacgttgcgcttgctggatagccatcctaatatcgaagttcgtctgtttaatcctttctcttttcgtacgctacgcgcgctgggatatttgacggattttgcgcggctgaatcggcggatgcacaataaaagttacactgccgacggcgtagtgacgctggtcggtgggcgcaacatcggcgatgcctatttcggcgctggcgaggagccgctattttccgatctggacgtgatggccattggcccggtggtcaatgatgtcgccaatgattttgaacgttactggcgctgtagttcagtgtcgacattgcagcaagtattatccctttctgagcaggaactgacgcagcgtatcgaacttcccgaatcctggtataacgatgagatcacccgccgttatctgcataagctggaaaccagccagtttatggcggatctcgatcgcggaacgttgccgctgatttgggcaaaaacacgcttgcttagcgatgacccttctaaaggcgaggggaaggcgcagcgccattcgcttcttccgcagcgattatttgacgtgatggggtcgccgacggagcgtatcgacattatttccgcttactttgtccctacgcgcgcaggcgtggcgcagttgcttaatctggtcaggaaaggcgtgaagatcgccatcttaactaactctctggcggccaacgatgtggcggtcgttcacgcagggtacgcgcgctggcgcaagaaattactgcgctatggcgtggagctctacgaactgaaaccgacccgcgaacatgaaaccgccgtacatgatcgcggactcaccgggaactcaggttccagcttacatgctaaaacgttcagtattgatggtagtaaggtgtttatcgggtcgcttaattttgatccccgttcaacgcttttaaataccgaaatgggctttgtcattgaaagtgaaacgctggcgacgcttatccataagcgttttacacagagccaacgcgatgcggcctggcaactgcggctggatcgctggggacgaattaactggatcgatcgtcagcaagaagaggaaaaggtgttaaagaaagaacccgctacgcgtttctggcaacgagttctggtacggttggcggcaattttacctgtggaatggttgctgtgaacccacgcgcggaaaactacccgatcgtggcgcgactttctcgttttaccggcggtttacctgaaaagagaaatttcaggagcgggatgcgtaaatgaatttcatacagaattaacgcaatacccataacaaatatcagcccgcacaagaacccgatcaggttggaggagatatgcggcgtaatatacgcgccaaagaaaagcgttaagggatgatgcaccagatagataaacagcgaagcattcacgaaataggtgacacgcgcggactgaaagtttaacaagcgatgccccagtgaaaataccacgttcaccatccatagccccattaccatcgtaatcacggattcggtttcgtacatccaggcgtcgccgctcccataacgttgattcagcagatacgcgataaaagcaacggcagcgcctaaagtgcatccgcgtgagggcgtggtgaagcgcgctttcagatcggggtgaatgaaggccaacgcgccgagaataaaaaacggcacataaaatagcgtttgcatcacaataaaattgaacatgccgtcactgaggattgccggatatacgatgaatataatgcgcctgatagcagcgtaagccacccccagcaggaaaaaaataagcgaaagtttggccagcgaaatagcggcgggacgaggcttgcttgtttcctgccttttttggaaccaggtaaaaatcccgatgctgacggtggttaatatcaccagcaccagtaaaaaccacagatgtgaaatgagttcccacgctaacgtattatatttttcataggcagagagtgtaggccagttctctgttttctctttgacatattgcaacaggataaattgcggcaaggtaagcaaagggattgcggtaagcatgggaatacccacacgttctacccgtactttccaccagtgttttaatggataacgtaaaaataacatgtacgaaaaataaccagaaataacaaaaaacacctgcatacgaaaagcgtggataaaatcgttaaacagggttagccaccacgatggcgcggcgctattgacatgccaactgtgagtggaatagatcaacgagatatgaaagggaatccctaacaacatcagccatgcgcggatagagtcaagaaaatattcacgcggcgcgggtacagagctcatataaggtcacgtattctcagatttttcaccttatccataaggcgaattatagttacattcggtagcaaccctacaccaactccgacaacctgtctccaggataagcacgcaaagtgaaaacaggcgcgggaggtgcttaatccatgagccagcgcgctgaacaaagcctggattcagttgtcgtaatgcctgattatccattaaaatggatcggatcgatataagcacacaaagggggaagtgcttacttattatgaaacataaacgacaaatgatgaaaatgcgttggttgggcgcagctattatgttaacgctctacgcatcatcgagctgggcgttcagcattgatgacgtggcaaaacaagctcaatctttagccgggaaaggctatgaggcgcctaaaagcaacttgccctccgttttccgcgacatgaaatatgcggattatcagcagatccagtttaacagcgataaagcctactggaacaacttaaagaccccttttaagctcgaattttaccatcaggggatgtacttcgatacgccggtcaagattaacgaagtgacggcgacgacggtcaaaagaatcaaatacagcccggattacttcaattttggcaatgttcagcacgataaagacacggtaaaagatttaggcttcgccgggttcaaagtcctgtaccccattaacagtaaagataagaacgacgaaatcgtcagtatgcttggcgccagctatttccgcgttatcggcgcaggccaggtatatggcttatctgcgcgcggcctggcgattgataccgccttaccatctggtgaagagtttccccgctttcgcgagttctggattgagcgtccaaaacccaccgataagcgtttgaccgtctatgcattactcgattctccgcgcgcgaccggcgcttaccgttttgtgatcattcctggccgcgataccgtggtggacgtgcagtcaaaagtctatctgcgcgataaagtgggcaagctgggcgttgcgccattaaccagtatgttcctgtttgggccaaaccagccgtcgccgacgaccaactatcgtccggaactgcatgactcgaacggcttatccattcatgcgggtaatggcgagtggatttggcgtccgctgaacaatccaaaacacctcgctgtgagcagctatgcaatggaaaaccctcagggattcggcctgttgcagcgtggtcgcgagttctcgcgctttgaagatttagacgatcgctacgacctgcgtccaagcgcctggattaccccgaaaggcgactggggcaaaggtaaggttgaactggttgaaattccgaccaatgatgaaaccaacgataacatcgtcgcttactggactccggatcaactgccggaaccgggtaaagagatgaacttcaagtacactctgaccttcagccgcgatgaagataaacttcatgcgccggataatgcctgggtgctgcaaacacgccgctcaacgggcgacgttaaacagtcaaatctgattcgccagcccgacggcactattgcctttgtggtggatttcgttggcgccgacatgaaaaaactgccgccggatacgcccgtcgctgcgcaaaccagcattggcgataacggtgaaatcgttgacagtaatgtacgctataacccagtcactaaaggctggcgtttaatgctgcgcgtgaaagtcaaagacgcgaagaaaaccacggaaatgcgtgccgcattggtgaatgccgatcagacgctaagtgaaacctggagctaccagttacctgccaatgaataaaacaactgagtatattgacgcattgctgctttctgaacgtgagaaagcggcattgccgaaaactgacatccgcgccgtgcatcaggcgctggatgccgagcatcggacttactcgcgagaagacgattcaccgcagggttccgtaaaagcccgccttgaacacgcctggccggattcattggcgaaggggcagttaattaaagatgatgaagggcgcgatcagttgcaggctatgccaaaagcgacgcgctcttcgatgtttcccgatccctggcgaaccaacccggttggccgtttctgggatcgtctgcgtgggcgggatgtaacgccgcgctatgtttctcgtctgacaaaagaagagcaggcgagcgagcaaaaatggcgtaccgtcggcactatacgccgctatattttgttaattttgactctggcgcaaaccgtcgtcgcgacctggtatatgaagaccattctgccttatcagggatgggcgctcatcaatcctatggatatggtggggcaggatatttgggtctcctttatgcagctcctgccctacatgctgcaaaccggtatcctgattttgtttgccgtgctgttctgctgggtgtcagccggattctggacggcgctgatgggcttcctgcaactgcttatcgggcgcgataagtacagcatctccgcgtctacggttggcgatgagcccctcaatccggaacaccggacggcgctgatcatgcctatctgtaatgaagacgttagtcgcgttttcgccggtctgcgcgcgacctgggagtccgttaaagccacaggcaacgccgcgcatttcgacgtctatatccttagcgacagttataacccggatatctgcgtggcggagcaaaaggcgtggatggagcttatcgcggaagtgcagggcgaaggccaaattttttaccgtcgccgccgccgccgtatgaaacgcaaaagcggcaatattgacgatttttgccgccgctggggcaatcagtacagctatatggtggtgctggacgcggactcagtgatgagcggcgagtgtctgagcggcttggtgcgcctgatggaagcgaatccaaacgccgggattatccagtcttcgccgaaagcgtcggggatggatactctgtatgcccgctgccaacagttcgcgacccgcgtctatgggccgctgtttaccgccgggctgcacttctggcagttgggggagtcgcactactgggggcacaatgccattatccgcgtgaagccgtttatcgagcactgcgctctggcgccgctgccgggagaaggttcgttcgccggatcgattctttcccacgactttgtggaggcggcgctaatgcgtcgggcagggtggggcgtctggattgcctacgatctccccggctcctatgaagagctgccgccaaacctgctggatgagcttaaacgcgaccgccgctggtgtcacggcaacctgatgaactttcgtctgttcctggtgaaaggaatgcacccggtgcatcgcgccgtgttcctgacgggggtaatgtcatatctgtccgcgccgttatggtttatgttcctcgcgctttctaccgcgctgcaggtcgttcatgcgttaacagagccgcaatatttccttcagccgcgccagctttttccggtctggccgcagtggcgtccggaactggcaatcgcgctgtttgcatcaacgatggtgctgctgttcctgccgaagctgctcagtattatgctgatctggtgtaaaggcaccaaagagtatggcggtttctggcgcgttacgctgtcgctgttgctggaagtgctgttctccgtattgctggcgccggtgcgtatgctgtttcataccgtgtttgtggtcagcgcgtttctcggctgggaagtggtctggaactcaccgcaacgcgacgatgattctacgccgtggggagaagcctttatgcgtcacggctctcaactgctgctggggctggtctgggcggtgggtatggcgtggctggatttacgctttctgttctggctggcgccgattgtcttttcgctgattctgtcgccatttgtttcggtgatctccagtcgttcaacggtaggattacgcaccaaacgctggaagctgttcctgatcccggaagagtattcgccgcctcaggtgttggtcgataccgataaatatctggagatgaatcgccgccgtattctggacgatggctttatgcatgcggtatttaacccgtcgcttaatgcgctggcgaccgcgatggccactgcgcgtcaccgcgccagtaaggtactggaaatagcccgcgatcgtcatgtggagcaggcgctaaacgaaacgccggagaaactgaaccgcgatcggcgtctggttttgctcagcgatccggtgacgatggcgcgtttacactatcgggtctggaatgcgccagagagatactcttcctgggtaaaccattatcagtctctcgtcctgaatccgcaggcgttgcagggacgaacatcgtcagcgagataaggtcttcaggtctggagtgaggtgaaaaataccggcgtgatgccggtatttttatagtgaaatgaggtatcaggtgcgtatattcgcggtgagcataatggtgattaccctgagcggctgcggcagtattatcagcagaacgatccccggacaaggacacggcaaccagtattaccctggcgtgcagtgggatatgcgtgattccgcatggcgctatatcactatcctcgatctgcccttctcactgatcttcgatacactgctactgccgctcgatattcaccacgggccttatgagtaattaacgctcatcccattcgtctgccgcagtacggccttcctcggtatcaagcgggggttcaagctggaattccccttcatcccattcatgcaaagtattctcttcctgccactcctggcggatctctatctcatcataatcgccgtcaaacacgctctgcgcggcttcaccactcagcatcggcagacattcgccatcttcaccttcatcggcgaaaaattcgacctgccacatgatgtccccatcctgcagtacatatttctgaacgttgaactgctgcacattcgcttcgtcttgttcgaggcctggatggtcagccagaaattcttcccgggctgcatcgatagcttcttccagcgtggcatacatggtcatcagtgtctccctttgatttgatgaggtatttagggaaagaatagctgattctgtaatattgcaagtatgaaagcgcaaaaattattctattgccagtctgcgccgtcgtaagctgttccatgaatagatagcattgaacaacaccacgcctgccgtgacgcagaatacggcgcggaagccatagctcgcggaaattgcggcgcccatgagagggccggtgacgttgccgatatcgcggaaagattggttgtaactgaatatgcgcccggctatctggttggtagagttgtaaaccagcagagtttgaacggctggcagcagcgcgccatccgccgcgccaagcagaaaccgcaatagcgcgagctgccacggcgtttgcacaaaagacattggaatcagcagcagtacggaaataatcagcgcgacgataagaatcttttccgggccaattctgtcgccaagcttgccgagccggggggcgctaagtaatgccgccacgccgggaacggacgctatcatcccgctaatgaacgcaatattactgacatctcccgccagttcgcgcacatagagcgtcaggatgggcgcaatagaccccgtcgccacctgaataatcagcgtggtgacaaacaggcttaataccaggcggggattttttaacgaggcgaccacttcccgaacgtgaagcatctcttttttgctcaccggcaggaaattctcgcgaatgaaaaagaaggtgagcagaaaacagataaacaaaacgctggcggtaataaaaaagaccggacgaaggccgtaatggtcggcgagcagaccgcccgcaagtgggccaagcagagcgccgctgacgccgccagtagagagcgtccctaacgcccagccgcttttgtggcgcggcacctgagtggcgatgagcgcattggcgttgggaataaatccgcccagcaggcctaataacgcgcggaggatcagaaattgccagatattttgcgccatgcccattaacagcatcacaatggccatgccgagagcggaacgcaacagcatgatcttacgccctttacgatccgccagaccgccccaaaaaggggacgcgatagctgaaaagaggaacgtaatactaaagaccagcccggaccacatgttgagcgcgctatggcctgttacgccgagttgctcaacgtagagagggagaaaaggcatgaccaggctgaatgccgcgccggttaaaaaacagcccagccaggtaacggttagattgcgtttccagtttatggggacatcagagggtgacatagcgttccacagtatgatgcgcggtttgcgctatcatcaatttaattatgagcgtactaattataattatgcgccgaccttaccagcctcgcaatgtggggagcttttaaagctaaaagaggggaaaaattgcagcctgacggctgcaatcctgtcaatagcgcgacggtacgccttcagggcgagttttaaagcggcgatgcagccacatatactgctctggcgccatcataatgcactgctcaacaatcttattcatccatgcggcagtcgcttctgcgctctccagcggaggcgaatattccgcaggaagaatgatcagttcgtagcctttcccatcgggtttacggcgaggcacgaaggggataatacaggctttagacatgcgcgcgagcatccaggtaccggaggtcgtggcagcctggtcgacagcgaataatggtacaaaaacgctggcgcgcgggccataatcgtgatccggcgcataccagatcaattcgccgcttttcaatgccttaaccatgcctttcagatctttgcgatccaacattgatttattggagcgtaagcgtccccaggtctgtaaccagtcgagcaacggattatcattcgggcgataaactccgatacccgggttatgcataccaaacatgcgggcgccaaactcaagggtaaggaaatgtattcctaccagaatgaaccccagtccctgcgccttaacttcacggatatgctccagaccgctcgcttccatccagcggttcactcgccgatcgggccagaaccaggccatgccggtttccatcacgcccataccgacggattcaaagtttttgaccaccatggtgtggcgttcctgcgcgctcatttccggaaagcataattcaaggttgcgataggcgatttttgcgcggcgtttcattacgcgtcgcgccaggtggcccaatgcgcaacccaatttatagatgaccgggtaggggagttgcacgaccaaccaaagcgcgcctatacccaaccaggttaaccaatagcgcgggtgcagtaaggccacggagaacttaggcaacttcgtcatttctatcctgtctttcaacgaacaattccccgtattctcgcatctttttgcgttgagcaaaaatatgtagcaggagagtggcgattaaatcgacaattgttgttaattatttagtgtaaagcaggaaatgtagcgcaaaatgtgtggatgtaaattggcgagacttgccttatcatgcctgcccactttattttttgctgattgcaggatacgtacaccatgccagtgttacacaaccgcatctctaatgacgagctgaaagccaaaatgctggcggaaagcgagccgcgtacgacaatttctttttataaatatttcactatcgcctctccgcaacagacgcgggacgcgttgtatcaggtgtttacggcgttggacgtttttggtcgcgtttacctggcgcatgaaggcatcaatgcgcaaatcagcgtgccgcaaagcaagctcgagacgtttcgtcaacagctttatacgttcgaccccgcgctggacggggtgcgtttaaatatcgcgctggaggatgacggaaagtcattttgggtgctgcgtatgaaagttcgcgaccgtatcgttgctgacggtattgacgatccgacttttgacgccagtaatgtcggcgattatctgaaggcggcagatgtgaatgcgatgctggacgatcctgacgcggtctttattgatatgcgcaaccactatgagtatgaagtcggccatttcgaaaatgctctggaaatcccggcggatacgtttcgtgaacagttgccaaaagcggttgaaatgctgcgggaacatgcagataaaaagatagtgatgtactgtaccggcggtattcgttgtgagaaagccagcgcctggatgaaacacaacggtttcaataaagtctggcatattgagggtggcatcattgagtacgcccgtcgcgcgcgcgcgcaggggcttcccgttcgctttatcggcaaaaactttgtatttgatgagcgaatgggcgaacgaatctcggatgaggttatcgcgcattgccatcagtgcggcgcgtcctgcgatagccataccaactgcaaaaatgacggttgccatctgctgtttatccagtgtccgcagtgcgccagtaaatttaacggctgctgtagtgaacaatgctgtgaagagttggccttgccggaggaagaacagcgccgacgtcgcgcgggtcgcgagaacggcaacaaaatttttaataaatcgcgtggtcggcttaatagcaaactgagcattcccgatccggctgagtaatattttgccggatagcggcgtaaaggccgctatccggcatttcgccaggcgttacttctgctgaacgccttctactgagatgataagctcaacctcttgtgaggccgggccgagatcggtagttatattgaaatccttcagcttaatttttccttcggcctcaaagcccgcgcgcttaccgccccacggatcgtcgccctggcccatcagcttcgcttccagcgtcaccggtttagtcacgccattgagcgtcagattgccggtaatatccagttcatcgccctcttttttcacgctggtagaggtgaaggttgcctgcgggaatttcgcaacattaagaaattccgcgctacgcaggtgtttgtcacgttcggcatggttagtgtcgacgctattggtgttaatggtcacgttcactttgtctgccgacggatttttttcgtcaaaagtgaacgtgccgtcgaaatctttaaaggtgccgtatagccagctgtagcccagatgctgaatgcggaaattgacgaacgcatgttggccttctttatcaattttatactccgccgccacggcggaaccggtcgtgaataacaaggatgcgagggtgaatcccagcaggttttttttcatttttgagctccatagtcagatgacgacattcctgtcatacgtttcagagtgtcgtctttatcgatgaaatggtgttttagcgccataaccccatgcgagagcgagataatgaccagcgaccaggcaaaccacagatgcagtgttccggcgatgtcagcctgcgcgcccgcgtccgtaagcgtggccggaatctcaaaccagccaaagacgctaatcggtttaccgtcggcggtggaaatcaggtagccgctaatgattatcgcaaagagcaggagataaaggaggagatgacctgcggcggcgccaatgcgcgttaaacgggaatagctggtcaacgcaacgggcggcggcgaataaagccgccagataatacgcacgatcagcgccatcatcagtaatatgccaatacttttatgtatttccggcgcctggtgataccagccgtcgtaataactgagcgtgaccatccataagcccaacgcaaacatgccatagaccaccagggcggtcagccagtggagcgcggcggaaaccacgccataacgctgtggagtatttttaaattgcataaacacaccaatgaatatttcacgagagaatgaaaatggcgtggaaaagcgccgaatgcaacttataaataagaatttgaatgatatttatttttatttcaataattttgatgttgtttgcggttcagcttcagaagtttcgagatatttccccctgataaccgcgcaacggcaagaactggcattattgccgtgcttcaacgttatgaaataaaaagtgaggaattttcaggaagtgtcagttaacgtcaatgaaaagcaatcagaagaaaaggagataaacaatatccatcaccgccagcagcgaccaaagaataacgtaaagcatgaaatgttcgcgaatattattcatcagaaaatgaaagagacgacgcatagcttaccttaataaacagcccctttacggggccgacaaattattggctaaaacgggaaagccggaacggcgtcagatcaaaggagggcgtttttcccaacgcaaaatccgcagcgatttctcctaacaccggggcgaatttaaaaccatgtccgctgagtccagtgatgacaagcgtgttctcatggccaggcagcgtatcgataataaaatcctcgtccggcgaattatcataggtacatgccgccccatgtaaacaaccgccgatacccggcagtacgttacgcaggaaaggaaatgcttccgcgccatcgctggcaacggcggcaaagggcttgcgctcttccggagcttgtattagctgtccgccattgtgtttgccgatttttaactcgtcgttctccgccgggaagccgtaatattgatcgccgttgggcatttcgccggtaaaggccggaaagcggtttttagtgctgtaacgcccatccgccttaaaccaggcaaaaactttacgtacgggctgaacgggcagctccggtaccagcgctttgacccaggtgcccgcgctaatcagcgccttgctggcgtggtagcagccttcactcgtctctatcgtcacaccgttatcatcatggtgaatatggcttaccgggctgttaaatagctgtgcgcagcctgcctctcgggccagacgaagccatgtggtaatggctaattcgctgcgcaggaaaccggagtcagcttcaaacagcccgatataattatcgggcacgcgaatttccggccagcgcgtcatgagggccgtcgcgtccaggcgctcgacgttcaattgccactgttgcgcgcttcgtgcgacgttggctaagaaagcggaatcggccgggccgaggttgacgacgccggagcggacaaaaataggctcttcattgtgtgtggagagttcatcccaaagcgtctgggcgcgaagcaccagcgggacatatttttcgccttcaccataagcgtggcggataagacgggtatcgccgtggtggctgccctgttgatgaggcggcatatgcgcatcggtcatcaggacctttagcccggcgcgggtggcgtaataaccagcggcggcgccaaccgaaccgctgccgataataataaggtcgtatttcatcagcttctctctgctatcgcgatgatttcagggtaaataactgcgctgagatatacaagccagaaataagtgaggcaccttacggtgcctgagagagggggagcgcgtcacgctaatggcgacgatactcgttttcctggtaatcgcctgattctattttggcgatgccggcttctaatattgaaataaattgcctggctacatctgttgttaaccagagcgtttgaccaacttcagtcccttccggttccggacgatttggggtctggtagtgtaaacgcagcatcagcgcatcatagctatcgacggtgctgatgtcccatcctacaagcggatgggtctgaatgacttcattattcttttccatcatgcccccctggtacgtgttataagacaacggttctcgaggttcaatgcgtgtttttcttctgaagcaacttcagtataccaattaataaggctattcactgcgtttttaaagagaccggaggataaatttctctttttaagaattatatgaacaataaagcggcagttcattcatatttttttaggatgttgtgcaattattttgagggtcaggtgaaatattcatcagttgcgcaaataaaaaagccggggcgacccggcaaacatacatcactgcatatcattttttattcattgatgaaccagtcatcagcgctctcccaggtctcctggagaatctcgctaatgcgttctttgtcctcttttgatgcgccaatgacggacaagttgttggcggtagcgtaacgcacggtgacgttacccaaattctccggaaaatgatggctaatacggcgggagagttcgcccgccagcgcatcaatcgcaccggcaggcagaggtgacgttttggctatagtgacttcaatacgcataatggccccctgttgaatatactggatatatatacagttaaatccagtatatagcaacaggtaagcgcattttttatttttttactgaccagcgtactgtttcacccgctaaaaaaggcaccagagaatcatcagccagcgcgatatttcccggtatctgttgttcatcgcgaaccagttccacccaccccgtattcatcggcaggccatagaattgcgggccattcagtgaacagaacgcttcaaagtgcgccagcgcgttcatttcctcaaacacggcggcataactgccaagggcggagggggcgttgaaacaaccggcgcagccgcaactggtctctttacgatgacgtgaatgcggcgctgaatccgtccccaggaaggcgcgcgtaaaaccactggcaaccagttcgcgtaacgcctgctggtgaatattgcgtttcagaatcggcagacagtacaggtgaggacgaatgccgccgaccagcatatcattacggttaaacattaaatgttgaggcgtaatggtagccgccaggtagtcgttgccgtcacgtacatactgcgcggcatctttggtcgtgatgtgctcaaagaccactttaagcgcggtcagacgctggcgtagcggttccattacggtgtcgataaaacgcgcttcacgatcgaatatatcaacatccgcatgggtcacctccccgtggaccagcaatggtattccgagtttttccatccgctccagtaccggcatgatagcgtcgactgacgttacgccatgactggagttagtggtggcattggccgggtaaagcttagccgcagtaaatacgccttcatggaaaccacgctccagttcatcggcatcgagcgaatccgttaaatagcaggtcattaacggcgtgaaatcatgcccggcgggcaccgcatcgagaatacgctggcggtaggcgatcgctgcatcaacggtcgtgatgggggacgccaggttcggcatcacgatagcgcgaccataaatttcgctggtatagggtacgaccgtttttaacatgtcgccatcgcgaaggtgaacgtgccagtcgtccgggcggcggatctttaaaacctgggatggtgcagtcattaataagctccggctgaggaatagtctttttgccggaaacaaaggataagcggaaacgttttcgtttgcacgtaaaaaaaagggcgcgagcgcgccctccgaaatcaattggtgaaaggaataacgatttcaccaggtttaacttcaatgcctttcgcgagtttctttgctaacgcttcgcctttactgctgtcctcacgcaacacgtaagcgggccgctggttaaagtagctacgtaaagactgatttaaataaggcaggagcgtttgtagcaccgattgcattttctccggcgtcacggtggcgtctactacttccatctcctgaagatagatggcgcctttttctttatcaaagaccggcagggcttttagcttgagtttcatcgtcgctttttgactgccaaacagggaattcatatccagcctggcatcgccagtaagggtgactttattaggttcttcccgaccaatctggctgacaaggttagtcaatacgatatgcgcgtcggcaatgccgggcagaccaatatcttttgagaaattattccgtttttcaagcgcttgattgatttcttgttcgctaatggtgtattgcgtaagttgattacaacccactaacaggccgctaactaccagcgcagcggcaaaaaaaaactttttcatggcgttccttagcatgttgcctgtgccctaatcttgacacaaagcagcatgtcgcgccagcggacatggtgccactagaaaaagctgaaaaaggcggcaagaaagggttgccgcctggcgggagttagatagccattgaggagagtaaattaatttgcgtctgctttgccatattatcgcgatagtccgcgacttttgtcggccagtggataccggcgaccagcgtcagattacgcagaagcggaaacagatgaatatcatcttccgataattcgccgttaacggcgttaggctgtacgatgagtttatccagcaaacgtaaatcatcgccgatctttttaatcagtcctgcagagtgcgcaagatggttgtcaaaactgccagatgaggcttcttttttgcggataaaatactgacgcgccgcaggggtagaaaattcatcgaaagcggattttgcaaatcgcggcagcagtagctgattaacgtaaccgttaactttgcgcaaccactcttcaatggctggattgcgtttcccggttaacagcggtttgccgtcgaggttgtcgacataatgtacaatatccatactttcaggaaggtagcgactatcatctttttgcaggatgggcaccatcttttgaccaatcatccgggtgggcgtcgcctcgtcgtcattttgtaacacgttaagttcaacggggatgttcttcaggccgaaaatcatgcgggctttaacgcagaaagggcaatgatcgtaaatataaagcttcacgtttctcctccatttgactgtcggtatctgaccagtatggaggagatagcgacaggtatcaaatcaggcgccgggttccagcatccggcgcggcgtgcgtttatgactaaattgccagcctaaagccaaaaaggtgataaagccgataataccgagcatcatccacggtagttcaggctgcgcaagcgctttccccatatcaaacaaccagccgccgccgatataaccaatcgcgccgccaatggctaatcccagacggctaaagcccatatagcttccccgcgccctcgcgtctgcgagcgacgcgctgagcgtttcgcgcgccggttcggcgataaccgagccgatgtagaaagcgcaaataagcgtaaaaagctgctgtaaattgcccaccatcccgatggggagcatgctcagcgacatgacgagcaaaccggccatcagccgatgctccagccgaaaacgcttttcgctccagcgggcaatcgggtagagcaacgtcagcgagagacacgcctcaatagcgtacatccatttcacggcagcaggcgaaccggcgatatcgtttaccataatcggcagcattaacatgacctgtaccgccagcatatagtagcccgccagcgtcagcacgtaggttacaaaccttttatcgctcatgacgcggcgcattccttcacgcaccggcgttctgaccgttgatagcttccaggccggaagcagccatgcgttgaaaagggcgcataatatgaacaaaatagcgcccgtcgcgcagaccaggcgaaaatcgtattgtagcaaccagcttcccagcagcgcgccaatcaccgcacccgcgctgtcctgcatcatcaacagagagaagaagcggtcccgttgctccggacgaattaatttgaccaccagcgctgaacgcggcgggtcgaaaagcgtaccgccgagaccggaaagaaagcaggaaaaccacaagagccagggctcatgcgcgatacccatggtggcaaagcctgcggcgcgcatcagcataccggtgacaatcatcggtttcgcgccaaagcgatcggcgatggcgccgccaaaaatgcccagaccttgttgaataaactggcgcaggccgagcgcgatccctaccattacggcagcccaccccatttgatcgacaaagcgaatagagatgagcgggaagacgacgaaaaaacccagcaccaccaacatgttatcgatgagaagaaaatatttacccaggttcctcgcctgcgagacgcgcgacatttcccctcccgggaaataaaagatgagcgtcttctattctgcggcggcgtttcgttttttcctaccgttagcgggacaatatttttttatcaaaagtcctttttaatcgagagttttcatcaaaatgtggcagcaattcaaaaaatgacgatttgcgcttttcacagagcctggttgcgcaagtatagtaatgttactggcgtgctgaagacgttacaggaaggagtaggtatagaatgtttggctatcgtagtaacgtgccaaaagtgcgcttaaccaccgatcgtctggtggtacgtttagtgcatgagcgtgatgcctggcgtctggccgattattacgcggaaaatcgtcattttttaaaaccctgggaaccggtccgtgatgaaagtcattgttatccttcaggatggcaggcgcgtctgggaatgatcggtgaatttcacaaacagggctccgccttctatttcgcgctacttgatccggaagaaaaagaaattatcggcgtggcgaatttttccaatgtggtgcgcggttcttttcatgcctgttatctgggctattccattgcgcagaagtggcaggggcaagggctgatgtttgaagccttaaccgctgcgattcgctatatgcagcgcactcagcatatccaccgtatcatggcgaactatatgccgcacaacaaacgtagcggcgcgttgctggcgcggcttggctttgaaaaagaaggctatgcgaaagattacctgttgattgatggacaatggcgcgaccatgtcctgacggcgttaaccacgccgttatggacgccggggcgttgagcggcttacggaatgagaggcaaagggagaaaacgatgaaatatgaattaaccgccactgaagcgcgagtgattggctgtctgctggaaaagcaggtgacaacgccggaacagtatccgctttccgtcaacggcgtggtgacagcctgtaatcagaaaaccaaccgtgaaccggtgatgaacctgacggaacaagaggtacaagaacagctcgataacctggtgaaacgccactttttgcgtacggtcagcgggtttggcaaccgcgtcaccaaatatgaacagcgtttctgtaattccgaatttggcgatctgaaacttagcgcggcggaagtggcgctcgtcactacgctgctgctgcgtggcgcgcaaacgcccggcgagttgcgtagccgggcgtcgcggatgcatgaattcagcgatatggcggaagttgaatccacgctggaacggcttgccagtcgtgaggacggcccgtatgtcgtccgtctggcgcgtgaaccgggtaagcgcgaaagccgctatatgcaccttttttgcggcgacgtcgatgaactgtctctccagacgtctgcgccggaaagtgcgtcgggcgatcttcagtcgcgcgtcgaagcgctggaaagcgaagtggcggagttaaagcagcggctggattctttgttagctcacctgggagagtaatgtgagaacattacggattggcattgtcgggttaggcggtattgcgcagaaggcctggctgccggtattaaccaacaccgccggatggacgttacagggcgcctggtctccttcgcgggataaagccttacgtatttgcgaaagctggcgcataccgtatgtggattcgctggcgaatttagcgtccagctgcgatgcggtctttgtccactccagtaccgcaagccattatgccgtggtcagcgaacttctcaatgccggcgtccatgtctgcgtggataaaccgctggcggaaaatctacgtgatgccgaacggctggtggcgctggcggcgcaaaaaaaattgacgctgatggttggctttaatcgccgtttcgcgccgctgtaccgcgaactgaagacgcgcctcggcactgcggcgtcactacgtatggataaacatcgtaccgatagcgtcgggccgcacgacttacgttttactttgctcgatgactatctgcatgtcgtggataccgctctgtggctggcgggcggcgaggcgcgccttgccagcggcacgttgctcaccagcgagtccggcgaaatgtgctatgcggaacatcatttttccgccgacaaactacaaattaccaccagtatgcaccggcgcgccggaagtcagcgtgaatcggtccaggccgtcaccgacggcgggctatatgacgtgacggatatgcgtgaatggcgcgaagagcgcgggcagggtattctcatcaaacccattcctagttggcaaacgacgcttgaacagcgtggttttgtcggatgcgcgcggcatttcattgactgcgtacaaaatcagacggttccggaaacggcgggggagcaggcgattttggcccagcgcgtcgtggaggcgctgtggcgggacgccatcagcgaataaccctctgtaacatctggcggtagtaattcatcgtaatccaggtactataccctcaataattcgagttgcagaaaagctaacgcacatgcagctcgaagtatggcgggtatatatgcccactctacacaatacctcttttcacagtgaataatggcaaaccgtggggagtctgtaaggcctgataagacgttttaacgtcgccgtcaggcgcggtgatacagccggatacggcagaagttgcgttatccggtcgatggatcagccatgcaggagttttacgccagggtctggaatacaaaagaaatgaatttattgaaatcgctggctgccgtcagctcgatgactatgttttcacgcgtgttgggctttgcccgtgatgcgattgtcgccagaatttttggcgcagggatggcgaccgacgccttttttgtggcgtttaaactccctaatttactacgccggatctttgccgaaggcgctttttctcaggcctttgtgcctatcctggcggaatataagagcaagcagggtgaagaagcgacgcggatctttgtcgcttacgtttccggcctgttgacgctggcattggccgtcgtgacggtggccggtatgctggccgccccgtgggtgattatggtaaccgcgccgggttttgccgatactgcggataaattcgcgctgacgacgcaactgctgcggattacatttccctatattctgctgatctcgctggcttcactggttggcgccattctcaacacctggaatcgcttctctattcccgcttttgcgccgacatttcttaatatcagcatgatcggttttgcattattcgccgcgccatactttaatccgccggtgctggcgttagcctgggcagtcaccgttggcggcgtgctgcaactggtgtatcaacttccgtatttgaaaaagatcggtatgctggtgctgccgcgcattaactttcgcgacaccggggcgatgcgggtggtcaaacagatggggccggcgattttgggcgtttccgtcagtcagatctcccttatcatcaataccattttcgcctcgtttctggcctccggctcggtctcatggatgtactatgccgatcggttgatggagttcccgtccggcgtgctgggcgtggcgttggggaccatcttgttgccgtcattgtcgaaaagctttgccagcggcaatcatgatgagtactgccgcctgatggactgggggctgcgtttgtgctttttactggcgttgccgagcgcggtagcgttaggcattctggcgaagccgctgacggtctcgctgtttcagtacggtaaattcaccgcctttgatgcggcgatgacgcagcgggcgttaatcgcctattcggtggggctgattggcttgatcgtcgtaaaagtgctggctccgggcttctattctcgccaggatattaaaacgccggtgaaaatcgccatagtgacgttaatcatgacgcagttaatgaacctggcgtttattggaccgctgaaacacgccgggctgtcgctctctattggtttggcggcatgtctcaatgcgtcgctgctgtactggcaactgcgcaaacagaatatctttacgccacaaccgggctggatgtggttcctgatgcgtctgatcatttccgtactggtgatggccgccgtattgttcggcgtgttgcatattatgccggagtggtcgcaagggtcgatgctatggcgtttgctgcgtttgatggcggtagtgatcgcgggtatcgcggcctatttcgccgcgcttgccgtgctgggctttaaagtgaaagagtttgttcgccggacggcgtaaattcagtgcctgatagcgctgtgctatcaggcctacaaggcattcaggccggaaaggcgcaacgtcgccatccggcaatgattagatagaaatttttttaccgccgcggtgagagacggaagtctgaccgtcagccccgtacaaggtcggctcctggtgaggtttcagcacctccagcgcctgttgattacgctcgatttgcccttccagcagccagccgttgtgctggttgaggtcgcgaagatgctgcgttttttcggtaatcgcctgccagcgctctgcaatgtcatcgtttgcgctacgctgcgcattctgctccagacggcgctgttgttccagataatccagcgtcgccagcaacgagcttttttcttctgtaatacgctgtagctggctgccgttaatctggcctacggaaagctgttgttgctcggcgtccatcaccgtcttcaggtcattcaggacggtggtcatctggtcaagtatttctgacaaacgagtcatacgcttatttactctgtaagtagctctgcgcctcgcgaatgagcgagtctgctatttttcccgtatccatttttaactcaccgttacggatagccgtttttaatgcttcgacgcgttccatattaatgtcgctgacgcctggctgcatgagcttcgcttgcgcgtcgcttaacgttacgctggcgctcgtcgcggcggacgttttttcctgacgcgttttttgtaccggcgtgtcgctggtttcgcgcgtctggacagtgctaacgggtttcaaaggtgaggtacggtcaatgctcatttatttatcctcatcgagggttacgttgtagcggccagctaccatcatggttgaatatctcatcggcagccgcgacaaaatctttacacaattataggttaataagaatattcccatcagaatcgacggttccactcacgatttgacccgatgtcatgcgcacgcgcgcattttgcgcgacggcagcattattcatcgcctgaccttccgcattgacgctgaacccctcgccattggcgatgacctgtactcgttgccccgctttgacgcgccaggcctgacgtatcatcgtaagctgtaccggctgcccgggagcgagatcgcgcaaactgacggcatcctgaatctgacggatatccagtaccgtccgcggcggtaactgatccagcctgccacgttttagcgtgacgttggccggcgtcaattttccgccgcgcgcgatgggcgcggcaacggcgacataattgccggtcgcttgcacattcacctgcaaataacgtttttcattggcgcagcgcgccaccacattgacgttgccccacagcttcgcgctgcccgtcatgctgaaggctggctgttcgcagctcggtagcagattgggcgatgaacggagcgtgacaaccacctcgtcgctgaagccagccagacgctgggaaaaccacgtggtcagctgggcgttgatgtcctgcgccattgtcagggggctgaacagcaaagccgccacggcgaatcctcgttttaacgtttgcatggtacttccccctggttgatgtcatgacaggattctacccgtgtgaagcaagcatcaacgcaataaatagcgacgcattttgcgtttattccggcgataacgcgcgcgtgaaggcatttaagctgtcggctgaattttgccatttgcggaggagatatgctcgacaggctcgatgccgccttacgatttcagcaggaagcgctaaatctgcgcgcgcaacgtcaggaaatattagcggcgaatatcgccaatgccgatacgccggggtatcaggcgcgcgatattgattttgccagtgagttaaaaaaggtgatggtgcgtggacgggaagaaaccggcggcgtcgcgttaacgttgacttcctctcaccatattcccgcccaggcggtctcttctcccgcagtggatctgctttatcgcgtacccgatcagccttctttggatggtaataccgtagatatggacagggaacgtacgcagtttgcggataacagtctcaaatatcagatggggcttaccgttctgggtagccaactcaaaggcatgatgaatgtgctacagggaggaaactaattcgtggcgctgttaaacatttttgatattgccggatcggcgcttgccgcacagtccaaacggttgaacgttgcggccagtaacctggcgaatgcggatagcgtcaccggcccggacggacagccttatcgcgccaaacaggtggtttttcaggtggacgccgcgccgggtcaagccactggcggggtaaaggtcgccagcgtgattgaaagtcaggcaccggaaaagctggtttatgagccaggcaatccgctggcggacgctaatggttacgtcaaaatgcccaacgtcgatgtggtcggcgaaatggtcaacacgatgtcagcctcgcgcagctatcaggcaaatatcgaagtcctgaataccgtaaaaagcatgatgcttaaaacgctgacattaggccagtaaaggaggcgcgtatgtctattgccgtaaatatgaatgacccgaccaacacgggcgtcaaaacgacgaccggcagcggatcgatgaccggaagcaacgctgccgatctgcaaagcagtttcctgaccttactggtcgcgcaattgaagaaccaggacccgactaacccattacaaaataatgagttaacgacacagttggcgcaaatcagtaccgtgagcggcattgaaaaactgaatacgacgctgggggctatttccgggcaaatcgataatagtcagtccctacaggcgaccacgctgattggacatggcgttatggtgcctggcaccacaattctggcgggtaaaggcgcggaagaaggggccgtgacgtccacgacgccgtttggcgtggaattgcaacagcctgcggacaaagtgacggcaaccattaccgataaagatggccgggtggtacggacgctggagatcggtgagttgcgagccggggtacacacctttacctgggatggtaagcaaacggacggaacaacggtaccgaatggttcttacaacattgcgattaccgccagcaatggcgggacgcaactggtggcgcagccgctgcaattcgctctggtacagggcgtgacgaagggcagtaacggcaacctgttggatctgggtacctacggcaccaccacactcgacgaagttcggcaaataatctaagcccttacacttatcaggagtcagtcatgtctttttctcaagcggttagcggcctgaacgctgcggccaccaaccttgatgttatcggtaataacatcgccaactccgccacctatggctttaagtccggtacggcatcatttgccgatatgttcgccggttccaaagtggggctgggcgtaaaagtggcggggattacccaggattttaccgacggtacgacaacgaacaccgggcgcgggctggatgtcgcgattagccagaacggttttttccgcctggtagacagcaacggttccgtgttctatagccgcaacggccagttcaaactggacgagaaccgtaacctggtcaatatgcaggggatgcagttgaccggctatccggccaccggtacgccgccgaccattcagcagggggcgaatcctgcgccgatcaccattccgaacacgctgatggcggcgaaatcgaccaccaccgcgtcaatgcagatcaacctgaactcaacggaccctgtaccgtctaaaacgccctttagcgtgagtgatgcggattcgtataacaaaaaaggcaccgtcaccgtttatgacagccagggtaatgcccatgacatgaacgtctattttgtgaaaaccaaagataatgaatgggccgtgtacacccatgacagcagcgatcctgcagccactgcgccaacaacggcgtccactacgctgaaattcaatgaaaacgggattctggagtctggcggtacggtgaacatcaccaccggtacgattaatggcgcgacagcggccaccttctccctcagcttccttaactccatgcagcagaacaccggggctaataacatcgtcgccaccaatcaaaacggctataagccgggcgacctggtgagctaccagattaacaacgacggcaccgtggttggcaactactccaacgagcaggagcaggtgctggggcagattgtgctggctaacttcgccaacaacgaaggtctggcatcccagggcgataacgtctgggcggcgacgcaggcttccggggttgcgctgctggggactgccggttccggcaacttcggtaagctgacgaacggcgcgctggaagcctctaacgtggatttgagtaaagagctggtgaatatgatcgtcgcgcagcgtaactaccagtcgaatgcgcagaccatcaaaacccaggaccagatcctcaatacgctggttaacctgcgctaagcgcctgacgggatagcttaatggatcacgcaatttataccgccatgggggcggccagccagacgcttaaccagcaggcggtaacggccagcaacctggctaatgcctcaacgccgggctttcgcgcgcagcttaacgcgctacgcgcggtgcccgttgatggcctctctttagcaacgcgcacgctggttacggcgtcgacgccgggggcggatatgaccccgggtcagttggactacacctcccgtccgctggatgtcgcgttacagcaggacggctggctggtagtgcaagcggcggatggcgctgaaggatatacccgtaacgggaatatccaggtgggtccgaccgggcagttaaccattcagggacatccggttatcggcgaaggcggcccgattaccgttcctgaagggtcggaaatcaccattgcggcagacggcacgatctccgcgctcaatcccggcgacccgccaaacacggtggcgcccgttgggcgactgaagctggtcaaagcggaaggcaatgaggtgcagcggagcgatgacggtttattccgccttaccgccgaggcacaggctgaacgcggggcggtactggccgccgacccgtcaattcgcattatgtcgggcgtgctggagggcagtaacgtcaagccggttgaagccatgaccgacatgatcgccaacgcacgtcgttttgaaatgcagatgaaggttatcaccagcgtagatgagaacgaagggcgagctaaccaactgctgtcgatgagttaatacaggacattttatgatcagttcattatggatcgccaaaaccggtctggacgcgcagcaaaccaatatggatgtgattgccaataacctggcaaacgtcagcaccaatggttttaagcgtcagcgcgcggtatttgaagatctgttgtatcagaccatccgccagccgggcgcgcagtcgtccgagcagacgacgctgccttcagggctgcaaatcggtaccggcgtgcgtccggtcgccacggagcgtctgcacagtcaggggaacctgtcgcagaccaacaacagtaaagatgtggcgattaaagggcagggctttttccaggtcatgctgccggacggtacgtctgcttatacccgcgacggctctttccaggtggatcagaatggtcaactggtgacggcgggcggttttcaggtgcagccggcaatcaccattccggccaacgcgttaagcatcacgattggccgcgacggcgtggtcagcgttacccagcaggggcaggccgcgccggttcaggtcgggcagcttaacctgaccacctttatgaacgacaccgggctggaaagcattggcgagaacctctatatcgaaacgcaatcgtccggcgcgccgaacgaaagcacgccggggctcaacggcgcggggttgttgtatcaagggtatgtcgaaacgtcgaacgttaacgtggcggaagagctggtgaacatgattcaggttcaacgcgcctatgaaattaacagtaaagcagtatcgacgaccgatcagatgctgcagaaactgacgcaactctaaggggccgccggtgggggatacgccaccggctccctgattttgaagatgaaggtaatgcaaaaatacgcgcttcacgcttacccagttatggccctgatggtcgcgacgctgacaggatgcgcctggatacccgctaaaccgcttgtgcagggggcgaccacggcgcagccgatacctggcccggtaccggtggcgaatggctccatatttcagtctgcgcagccgattaattatggctatcagccgctttttgaagatcgtcgaccgcgtaatatcggcgatacgctcacgattgtgttacaggaaaacgtcagcgccagtaaaagctcgtcggcaaatgccagccgcgacggcaaaaccagttttggttttgatacggtaccgcgttatctgcagggattattcggtaattcccgcgcggatatggaggcctccggcggcaactcttttaacggcaaaggcggcgcgaatgccagcaatacctttagcggcacgctgaccgtgaccgtcgatcaggttctggccaatggcaatttacacgtcgtgggggaaaaacagatcgcgattaatcagggaacggaattcatccgcttctccggcgtggtaaatccacgcaccatcagcggcagcaactctgttccctcgacacaggtggcggatgcgcggattgaatatgtcgggaacggctatattaacgaagcgcaaaatatgggctggctgcaacgtttcttccttaatttgtcgccgatgtaagcgaggtgtatgtgtttaaagctcttgcaggaatcgttctggcactggttgccactctggcgcacgccgagcgtatccgggatctgaccagtgtccagggagtacgggaaaactcgctgatcggctacgggctggtggtcgggttggacggtacgggcgaccagacgacccagacgccatttaccactcagacgctgaataacatgctgtcacaactggggattacggtccccaccggcaccaatatgcagttgaaaaacgtggcggcggtgatggtgacggcgtcgtatccgccttttgcgcgacagggacaaacgatcgatgtcgttgtttcctcaatggggaacgctaaaagtctgcgtggcgggacgttattaatgacgccgttaaaaggggtggacagccaggtgtatgctttggcgcagggcaatattctggtcggtggcgcgggcgcttccgcaggcggcagtagcgtgcaggttaaccagcttaatggcgggcgcatcactaacggcgcgattatcgaacgcgagttgccgactcagttcggcgctggcaacaccattaatctgcaattgaacgacgaagattttacgatggcgcagcaaattaccgacgccatcaaccgcgcgcgcggttacggcagcgccactgcgcttgatgcgcgaacggtacaggtacgcgtgcccagcggcaacagctcgcaggtgcgttttctggcggacattcaaaatatggaagtcaacgtgacgccgcaggatgcaaaagtcgtgatcaactcgcgtaccggttcggtggtcatgaatcgggaagtcacgctggatagctgcgctgtggcgcagggcaatttgtcagtgacagtcaatcgccagctcaacgtcaaccagccgaatacgccatttggcggcgggcagaccgtggtgacgccacagactcagatagatttgcgtcagagcggcggatcgctacagagcgtgcgttccagcgccaatctgaacagcgtagtgcgtgcgctgaatgcgcttggcgcgacgccgatggatctgatgtcgattttgcagtccatgcagagcgcgggctgtctacgcgccaaactggaaatcatctgatgatcggagacggtaaattgctggccagcgcggcctgggatgcgcaatctctgaacgaactgaaagcgaaagcgggccaggacccggcggcgaatatccgtcctgtggcccgtcaggtggaagggatgtttgtgcagatgatgctgaaaagtatgcgcgaggctttacccaaagatggtttattcagcagcgatcagacgcgtctgtataccagcatgtatgaccagcagatcgcccagcagatgaccgccggtaagggattggggctggcggatatgatggttaaacagatgaccagcgggcagacgatgcctgcggatgacgcgccgcaagtaccgcttaaattctccctggagacggtaaacagctatcaaaatcaggcgctgacccaactggtgcgcaaagccataccgaaaacgccggacagcagcgatgcgccgctctccggcgacagtaaagactttctggcccggctttcgctccctgcgaggctggccagcgaacaaagcggggtgccgcatcatctgattctggcgcaggcggcactggagtccggctgggggcagcggcaaatcctgcgggagaatggcgaacccagctataacgtatttggcgtgaaagcgaccgccagttggaaagggccggtgacggagatcaccaccactgaatacgaaaatggcgaagcgaaaaaagtgaaagcgaaattccgcgtctatagctcgtatctggaggcattatcggattatgtcgcgctgttaacgcgtaacccacgctacgctgccgtgaccactgccgccacggcagagcagggcgcagtggctctgcaaaacgccggatacgccactgacccgaattacgcgcgtaaattgaccagcatgattcagcagttgaaagcgatgagtgaaaaggtcagcaaaacctacagcgcgaatctcgacaatctcttttaaattgctcaagtccacgtagtcgctgccgataacaacgagtattgaaggattaaaaggaaccatcatgtccagcttgattaatcacgccatgagcggacttaacgccgcgcaggccgcgttaaatacggtcagtaataacatcaacaattataacgttgcgggttatacccggcagacaactattctggcgcaggcaaacagtacgttaggggctggcggctggataggtaatggcgtttacgtttcaggcgtacagcgcgaatatgatgcgtttatcactaatcagctacgcggcgcgcaaaaccagagcagcggcttaaccacgcgctatgaacaaatgtcgaaaatcgacaacctgctggccgataaatccagctcactgtctggttcgttgcagagtttttttaccagcctgcaaacgttagtcagtaacgcggaagatcctgcggcgcgtcaggcgctgattggtaaagcggaagggctggtaaaccagttcaaaaccaccgatcagtatctgcgcgatcaggataaacaggtcaatatcgcgattggctccagcgtggcgcaaatcaacaattacgcgaagcagatagctaacctgaacgatcaaatctcccgtatgacgggcgtaggcgcgggcgcatcgccgaacgacctgctcgatcagcgtgatcagttggtcagcgagcttaacaagatcgttggcgtcgaggtgagtgtacaggacggcggcacctataacctgacgatggccaatggctatacgctggtgcaggggtcgacggcgcgtcagttggcggcggttccctccagcgccgacccgacgcgaacgactgtcgcttatgtcgatgaggccgccggtaacatcgaaattccggaaaagttgctgaacaccggttcgctcggcgggctactgacgttccgttctcaggatctggatcagactcgtaatacgctgggccagttggcgttggcgtttgccgatgcgtttaacgcgcagcataccaaaggttatgacgccgacggcaataaagggaaagacttctttagcattggctcgccggtggtatatagcaacagtaataatgccgataaaacggtatcgctaaccgctaaggtggtcgacagcacgaaggttcaggcgacggattataagattgtttttgacggtacagactggcaggttactcgcactgcggataacaccaccttcacggcgacaaaagatgctgacggaaaactggagattgacggtctgaaagtgacggtagggaccggcgcacagaaaaatgacagttttcttctcaagccggtcagcaatgctatcgtcgacatgaacgttaaagtgacaaatgaagccgagattgcgatggcgtctgagtcaaaactcgatcctgacgtggataccggcgacagcgataaccgcaatggtcaggcattgctggacttacaaaacagcaatgtagtgggcggcaacaaaacttttaacgatgcttacgccacgttggtcagcgatgtgggtaacaaaacgtcaacgctgaaaaccagcagcaccacgcaggcgaatgtggttaaacagctttataaacagcaacagtcggtttccggcgttaacctcgacgaagagtacggcaatttgcagcgttatcagcagtattatctggcgaatgcgcaagtattgcagaccgcgaatgcgctgtttgatgcgttattgaatattcgctaaaggagaaggatgacatgcgtatcagtacccagatgatgtacgaacaaaatatgagcggcatcactaattctcaggccgaatggatgaagctgggcgagcagatgtctaccggtaagcgcgttaccaacccatctgacgatccgatcgccgcgtcgcaggcggtagtactctctcaggcgcaggcgcagaatagccagtacgccctggcgcgtacgtttgccacccaaaaagtgtcgctggaagaaagcgtactcagtcaggtgacgacggcgattcaaaccgcgcaggaaaaaatcgtctatgccggaaacggcacgttaagcgacgatgaccgcgcgtcgctggcgacggatttacagggcatccgcgatcagctgatgaacctggcaaacagcactgacggcaatggtcgctatatctttgccgggtataaaacggaagcggcgccattcgaccaggcgacaggtggttatcatggcggcgagaaaagtgttacccagcaggtggattccgctcgcacgatggtaattggccatacgggtgcgcaaatttttaatagcatcaccagcaatgcggtgccggaaccggatggctcggactccgaaaagaatctgtttgtcatgctcgatacggcaattgccgcactcaagaccccggtggaaggcaataacgtggaaaaagaaaaagccgctgccgccattgataaaaccaatcgcggcttaaaaaattcgcttaataacgtcctgaccgttcgtgcggaactgggaacgcaactgagcgaactcagtacgctggattcactgggaagcgaccgtgcgctgggacagaagctacagatgagcaacctggtagatgtggactggaactcggtcatctcctcctacgtcatgcaacaggcggcattacaggcgtcctataaaacgtttaccgacatgcagggaatgtcgcttttccagttgaaccggtaacacctctttttgaaacatatcacgaaactggatatgttttgtctgcccgcgccatccaccccggcgcgggcatttttttagtcgtcattgagttagtggtcatattgtcgcgcccgtagcgacgccatccgtacgtattatcccgcccgatctcataaacgcctggagtgactaaaagacgccatggggtgaggcattgccctgtaaggggcataaaaaagccgacctggcggtcggctttgtatcagcatttacatcattctaccggctgtgggcgtgtcgccggggcgctggcgtgacgtgtggcgctgtgtccgcctgccgcgcctttaccttcaaagtggaaggaaggccgctgccagtcgctatggtgcggggtttccggcacatattccggcgctggcgcacgcgtcatcggcgcgctggcgtgattatgatcgtcaacgcagacaacgtcctgcgacttttccaccacctgggccggtgcgataacggtttcttctgccgtgtgctccacaacagccgcttccgcttttgtctcttcttctggctcgacaacgacaacatcagctacgttttcagccaccgtaatggacgcgtcggcggtttctgctaccggttcggcgtcagcaataacctcttgcgccaccggcgtatcgctttcggcaatcagttgcggctgttcatcaactggcgcggcaatcacttccggatgcgttgtctcgacctcgacgacttccggcgcctgtggttcggcgacggtctgcggctcaacggcaacgttttctactgcctgtaccgacgcttgtggttcgagcgctgcggtcgcagcgataacctgctgttcagcgacaaccggttgtggcagcgccagatctgcttcacgctgctcgtcaacaacctgcgtttcctgaggacggacaatcgggtagcggatccagactttaccggacgccatttctggcgacgcgcaggcgacggttaacggcattggcgattgtgtcgggtagcgctcgtcacgatagcgacggcgacgctgaccgcttacgcgcaggtggcgcggagaacggcgggagcgacgcggcataccggtattatcgcgaggttctacgctatcatcctgctctggcgcgatatcggcgacgacaggtaaatcaactttcgccagctcggtacgcggcgctggaacgggctgttcaacgttttcaaccgggcgcggttcgtcgacgacgaccggcgtgtcaaccgtttcaaccactgcgctgttggtaaagcggactttctgattaagctggcgctgcttgcggcgcggctgaacctgctgaacgcgttcttcctgctcggtctcctggacaggttgttcttcgcggttaagcgcttttacttcctgctgcgcctggcgcttgtcatcattgcggcggcggctgcgttcgcgacgcggcgtctgttgctgttcatcgccggttttcactttttccgccgtttcctgctggcgggtatcgcgcgcttccgcattttgctgctgcgtctggcgacggttacgacgattatcgtcgcggctctcgccgccgtcacgtccggcacggttatcacgggtgtcgcggcgttcgttacgatcgcgacggttgttctgccgtggcttgcgacgatcctgctgacgctccgctttttcttccgctttcggcgcggctgtttcgacggttttcgtttcttcaccgctgaacagttgtttcagcgcgttaaggaagcggctaaacagacccggctgggcaggctgcgcggcggcaacattatcctttttcgccgtggcgacgctaaccgccggttcgacaggcgtcggcgccggaggcacatctggcatagcgaatgtcgccagcgcaggctgctccgggcgtttacgctcggcgtactcttcttcagaaggcagcgccatcgcttcttcgtgcagcttcggcagcatgtagctcagggtcggcgtttcttcccctttgcgtacgcgcagcacggaatagtgcggcgtttccatctgatcgttcgggacgatgacacagcggacgccatcctgacgcgtctcaatagcgttcactgccgtccgtttttcgttaagcagataagaggcgatcggcaccggaacaatggcatggacttcctgcgtattctctttcagcgcttcttcttcaatcaggcgcagaatggacagcgacagagattcgttatcgcgcacggtgccggtaccgctacagcgcggacacacgtgatggctggattcgcccagagacgggctcaggcgctgacgcgacatttcgagcaggccgaagcgggaaatatggctaatctgaatacgcgcccggtcctgacgcaccgcttcacgcagacggttttctaccgcgcgctggtgacgtaccggcgtcatatcgataaagtcgataacgatcaggccgcccaggtcgcgcagacgcaactggcgggcaatctcatcggccgcttccaggttggtattaaacgccgtttcttcgatatcgccgccgcgagtcgcgcgggcggagttgatatcgatggcggttaacgcttcggtactgtcaatgacgatggagccgccggagggcaggcgcacttcacgctggaacgctgactcgatctgcgattcgatctggtaatggctgaacaacgggatttcaccggtgtacagcttaattttgctgctaaaatccgggcggcccaacgcggcgatatgctgacgcgccatttccatcacttttggattgtcgatcaggatttcaccgatatcctgacgcagatagtcgcgaaacgcgcgtacgatgacgttgctttcctgatggatcaggaacggcgcgggacggctttcagcggctttctgaatggcctcccagtgtttcaggcggaagcttaaatcccactgcaacgcttcggcggatttacccacgcccgcggtacgcacgataagccccatcccttcaggaagttccaggctggccaacgcttcttttaactcggtacgatcgtcgccttcaatgcgacgggaaataccacccgcgcgcgggttattcggcatcagtaccaggtagctgcccgccagactgataaaggtggttaacgccgcgcctttgttgccgcgctcttctttatcgatttgaacaatgacttcctggccttcgcgtaacacgtctttaatgttcgggcgaccatgagcgctgtagttagcggggaaatattcgcgggcaatttcttttaacgggaggaaaccgtggcgttctgcgccgtaatcaacaaaagccgcttccaggctcggttcaatacgggtaattttgcctttatagatgttcgcttttttctgctcgtgtccggggctttctatatccagatcgtacagacgctgcccatctacaagggcgacgcgcaactcttcctgctgagtcgcgttgattaacattcttttcatcgtaacttactcattattcttacgttgacgactaagctgcgggcatggtgacgccttaccgggcatgaaccgatggcctcgtgactatttcgcgtcgccaacctcacggttatcgtcagctcaaagaggcgcagagtgtcggttgcctgtatttcatacggaaacacagcgcaattatcagggaagcagcctgggcattactctccagagaagatcctatctaccggtaaggactgcaacccgcagcccgctaactgtctgaaaaatcaatacgtcttacgccattgctgcgttgatgatcggtcagacaaaatgggttattccgctaaactttttgttttaacaagtttcggtgcggaaaccgcatcattattccactgctaaccttgttatagcaagatgacttttaccatttatcacccgcttactcacagttttttcaccagcgtgagccaatcgctttaataaccagcaaaaccgcagtgaaaaatgttcatccactggcgtagacgtctctataagcatagaaaaatgtgtggcgcgaatctcacaggctatttagaatcgccccccatgaaaacagaaacgccatccgtaaaaattgttgctatcgccgctgacgaagcggggcaacgcattgataactttttgcgcacccaactgaaaggggtaccaaaaagtatgatttatcgcatcttgcgtaaaggcgaggtgcgggtgaacaaaaaacgcattaaaccggaatacaaactggaagcgggcgatgaagtccgcattccgccggttcgcgttgctgaacgcgaagaagaggccgtgtcgccgcatttgcaaaaagtggcggcgttggcggacgtcattttgtatgaagacgaccatattctggtgctgaataagccttccggcaccgccgtacacggcgggagcgggttaagttttggcgtcatcgaagggctgcgggcgttgcgtccggaagcgcgattcctggaactggtgcatcgtcttgaccgcgatacctccggcgtgctgttggtggcgaaaaaacgctccgcgctgcgttcgctgcatgagcaactgcgcgaaaagggaatgcagaaagattatctggcgctggtgcgcggccagtggcaatcgcacgttaaaaccgtacaggcgccattattaaagaacattctgcaaagtggcgaacgcattgttcgcgtgagccaggaaggcaaaccgtcagaaacgcgcttcaaggtggaagagcgctatgccttcgccacgctggtgcgctgtagcccggtcacgggccgtacgcatcagattcgcgtacatacccaatatgccggtcaccctattgcgttcgacgatcgctacggcgaccgtgagtttgatcaacagcttaccgaagcgggaaccggtcttaaacgtctctttctgcacgccgcggcgctgaagttcacgcatccgggaacgggcgaagtcatgcgcattgaagcgccaatggataacgccctgaagcgctgtctgcaggtgctgcgtaacgcaaaatagttcctctttcgggcaggttatctgcccgaatctcacttttctcataatatttttgttttgctgtatccgacgcatttttaccgttgtgcactgtttattcttgcgatccggatttcggcgcgtttaaggacgaacagatggccaatactagctggatgcgctcatttactcagcgttggggaaaatacgttatcgtgccgctcgtgatcgcgatgctgaccggttgcgaagggaagggcgatagttcacgacgggctttcgttgagtatttgaatacgcaaatcattacgtctcccgtggtgggcgtctgtgagttgacgccagcccaacgtcaggcttttggtcattacgccgatgactacgatgtactattaactgcctacgggcaaatctttgctgtggtgtatgagaccggccaggaggataagatcaccggtgttattcagtctgagcgtgataatctggttttcctgaacgagctacgtgtggctcgtgacgtaaacaatcgatttatccttcggttgaaaaatgtgagtagtgaaaacagaaaaaaatattctgctttaaagctccccgctgatgtgaagcctgtctttgacgctgcgtggaataaaaccgtaacaccgctggatgagacgatgactcgctattattttctgcgcggaaagcggctcgaccaactggtcgcaatgggcgagtttctgcaaaaacagggaaataaagtccgctttgaaacgaatggaaaagcggtttttgccgacctggcagcaaaagaacactttcaggatcaacaatttaattttttcattacgcagaatgatataaaccatcttactcagcagatggttgaatttataaatagtcaacaagatgcggctgatgctggcggcgttaattaaaggaatgtgtcgtgaggtgaagcaatgttcgggggagggcgtaaactcatcgcgagatggaatttaacgagtcgcaaagggaaggtttcaggacagtaaacgtcctgagagttgttcgcgagaataagtttgtaagccgcttttgacgccgtagagcgcgtcaggcgagtattgagaacatgtgtttttacaaaactgaactgagatggggaattcattaacgcgcacgtacaccgctgttgataccctatgggataaaacgcaccgtacatcggttcgtaataccaatgctttttttctggtcggtgaatggattgaccaggaaacgggcccgcacgaagagagtgaagatcggcaggcgctaaattgttcacaacaagcgctttccagttggttagaactggaagcggtcgaaactgctccccaataaacgggagataactaccaacacgtgcagaaacggcttttagcggtatttgaaaagcctacagagtaggccgtttattgctgtagcgggttgaagccctcccgtcgcagcatctggcacagggcaataagcggcaagccgatcagcgtgttcggatcacgaccctccaggcgctcaaataatgcaatgcctaaaccttcgcttttaaaacttcccgcgcagtgcagcggatgctctttacggacatagtcgtctatttccgcttcgcttaaatggcgaaaatgaacgtcaaaaggctccacttcggtttgtaagtgcccggaggcggagttatacagtgccagtccggtataaaacgtcacaatatttccgctggctttggctaattgctgacgcgctttttcttccgtcagcggtttgccggtgatttcgccgtccagaacacaaatttggtcggagccaataatcaaatgattcgggaaacgcgcggcgagcgattgcgccttcgcctgcgccagccgcagcaccaactgacgcggcgcttcgcccggcatgggggtttcatcaacatccggcgcggcgcattcgaaaggaatcgtcagcttttccagcagcgcgcgacgccagggagaggtagacgcaaggatgagacggggcatattttttccctcagatatagcgtaatgatgagagccatcttaaactatgctcttcggtcttcaagcctgtcatactgactcgtcttgagcgaaaataagtctgtaacccgcaatgtgtgcgaattattggcaaaaggcaaccgcaggctgcctttttctttgactatatgacgttacgaagttaatatgcgcgccctatgcaaaaggtaaaattacccctgactcttgatccggttcgtaccgctcaaaaacgccttgattaccagggtatctatacccccgatcaggttgagcgcgttgccgaatctgtagtcagtgtggacagtgatgtggaatgctccatgtcgttcgctatcgataaccagcgtctcgccgttttaaccggcgatgcggtcgttacggtgtcgctcgaatgccagcgttgcgggaaaccgtttacccatcaggttcacacaacgtattgttttagccctgtccgttccgacgagcaggctgaagcactgccggaagcgtatgagccgattgaggtaaacgaattcggcgaaatcgatctgctggcgacggttgaagatgaaatcatcctcgccttgccggtagttccggtgcatgattctgaacactgtgaagtgtccgaggcggacatggtctttggcgaactgcctgatgaagcgcaaaagccaaacccatttgccgtattagccagcttaaagcgtaagtaataggtcttccccgcggacgcagggataaaccgtaattgaggagtaaggtccatggccgtacaacagaataaaccaacccgttccaaacgtggcatgcgtcgttcccatgacgctctgaccgcagtcaccagcctgtctgtagacaaaacttctggtgaaaaacacctgcgtcaccacatcactgccgacggttactaccgcggccgtaaggtcatcgctaagtaatcgcgcgatactcgatgccttttgcatcacaggcgtgcctgtggtgtaaaagccgaagagtacaagcgtgataaagcttagtgaggatttctccgcgtaagcggagaacaccgaaccaggcagcgacgataccttgacacgtctaaccctggcgttagatgtcatggggggcgattttggtccttccgtgacggtgcctgcagcattgcaggcactgaacgctaattcgcagctcactcttcttttagtcgggaatcccgatattatcacgccattacttgccaaagctgactttgaacaacgttcgcgtctgcagattatccctgcacagtcagttattgccagtgatgcccggccttcgcaggcgatccgcgccagtcgtgggacatccatgcgtgtggccctggagcttgtgaaagaaggccgagccgaagcttgcgttagcgccggtaataccggggcgctgatggggctggcgaaattattgctcaagcctcttgaggggattgagcgtccggcgttggtgacggtattaccgcaccagcaaaagggcaaaacggtagtgcttgatttgggtgccaacgtcgactgtgacagtaccatgctggtgcagtttgccgtgatgggcgccgttttggcggaagaggtcgtcgggatcaaaaatccccgcgtggcgctactcaatatcggggaagaagaaaccaaaggcctcgacagtattcgcgaagcctctttaatgttaaaaacagtcccaaccatcaattacatcggctaccttgaggcgaatgagttactgacgggaaaaaccgatgtactggtgtgtgacggctttacaggcaatgtcacacttaaaacgatggagggggttgtcagaatgttcctttcactgctgaaatcacagggcgaggggaaaaaacggtcgtggtggctgctgttattaaaacgttggttacaaaaaagcctgacgaggcgattcagtcacctcaaccccgaccagtataatggcgcctgtctgttaggattgcgcggcacggtgataaaaagtcatggtgcggccaatcagcgagcatttgcagtcgcgattgaacaggcagtgcaggcggtgcagcgacaagttcctcagcgaattgccgctcgcctggaatctgtatacccagccggatttgaaccgctggacgatggcaaaggcgtaaacctgcgggcgcacagataatatcgttgtctccccggcgccgccagcgtgccagacgtttacaggtaacggtatataaccgaaaagtgactgagcgtacatgtatacgaagattattggtactggcagctatctgcccgaacaagtgcggactaacgccgatctggaaaaaatggttgagacctctgacgagtggattgtcactcgtacaggtattcgtaaacgccatatcgccgcgccgaatgaaactgtcgcgacgatgggctttaccgctgcgaatcgcgcgattgagatggcggggatcgataaagaccaaattggcttgattgtggtggctaccacatcagcaacgcatgcatttccaagcgcggcatgtcagattcaaagtatgctcggtattaaaggttgcccggcgtttgatgtcgcggcagcgtgcgcaggtttcacctacgcgttaagcatcgccgaccagtacgttaaatccggcgcggttaaacacgcgctggtggtcggttccgatgtattagcccgcacttgcgatcctggcgatcgcggtacgatcattattttcggcgatggcgcaggcgcggccgtactgagcgcttctgaagaaccgggtattatctccactcatcttcatgccgatggccgttacggtgaattactgaccctgccgaatgccgatcgcgtaaatccggataacccgatttacctgacaatggcgggcaatgaagtctttaaagtggcggtcactgaactggcgcatattgtcgatgagacgctggcggctaataacctggatcgctcagaactcgattggctggtgccgcatcaggctaacctgcgtatcattagcgcgacagcgaaaaaactcggcatgtcgatggacaatgtcgtcgtcacgctggacaggcacggcaatacctccgcggcttctgtgccgtgcgcgctggatgaagccgtgcgtgacgggcgaattaaagccggtcagctggtattgcttgaagccttcgggggtggattcacctggggctccgcgctgattcgtttctagtataaggatttaaacatgacgcaatttgcatttgtgttccccggtcagggttctcagagcgttgggatgttggccgagatggcggcaaattaccctatcgtagaagaaacgtttgctgaagcttctgcggctctgggatatgatctgtgggcgctcacccagcaaggtccagcggaagaactgaataaaacctggcagacgcagccggcgttattaaccgcttccgtcgcgctttggcgcgtttggcagcagcagggcggtaaaatgcctgcgttaatggcaggtcacagcctgggcgaatattccgcgctggtttgcgctggcgtcatcaactttgctgatgccgttcgtctggtggaaatgcgcggtaaattcatgcaggaagcggttccggaaggcactggcggcatgtctgcgatcatcgggctggatgatgcctctattgctaaagcctgtgaagaatctgccgaagggcaggttgtttcgccggttaactttaactcgccgggacaggtggttatcgccgggcataaagaggcggtagaacgtgcgggcgcagcctgtaaagccgctggcgcgaaacgcgcgctgccgctgccggtgagcgtaccgtcgcactgcgcgctgatgaaaccagcggcagataagctggcggttgaattagccaaaattacctttagcgcgccaacggtgccggtagtgaacaacgttgacgtgaaatgtgaaaccgatgccgccgctatccgcgatgcgctggttcgccagttgtacaatccggtacagtggacgaagagcgtggaatttatcgcggcgcagggcgttgaacatctttatgaagtgggtccaggtaaagtcctcactggtctgacgaaacgtattgtcgacaccctgacagcgtcggcgctgaacgagccggcggcgctgtctgcggcacttacgcaataaaagaggaaaaccatgagctttgaaggaaagattgcgctggtgactggtgcaagccgtggcataggccgcgcaattgcagagactctcgttgcccgcggcgcgaaagttatcgggactgcgaccagtgaaaatggtgcgaagaacattagcgactatttaggtgctaacgggaaaggtttgatgttgaatgtgaccgatcctgcatctattgaatctgttctggaaaatattcgcgcagaatttggtgaagtggatatcctggttaataatgccggtatcactcgtgataatctgttgatgcgaatgaaagatgatgagtggaacgatattatcgaaaccaacttatcatccgttttccgcctgtcaaaagcggtaatgcgcgctatgatgaaaaagcgttgtggtcgcattatcactattggttctgtggttggtaccatgggaaatgcaggtcaggcaaactacgctgcggcgaaagcgggcctgatcggtttcagtaaatcactggcgcgtgaagttgcgtcccgtggtattactgtcaatgttgtggctccgggttttattgaaacggacatgacgcgtgcgctgtctgacgatcagcgtgcgggtatcctggcgcaggtgcctgcgggtcgcctcggcggcgctcaggaaatcgccagtgcggttgcatttttagcctctgacgaagcgagttacatcactggtgagactctgcacgtcaacggcggaatgtacatggtttaatcacgattgaaaaatatttgcgttattagggcgaaaggccgcaaaataacgtaaaatcgtggtaagacctgccgggatttagttgcaaatttttcaacattttatacactacgaaaaccatcgcgaaagcgagttttgataggaaatttaagagtatgagcactatcgaagaacgcgttaagaaaattatcggcgaacagctgggcgttaagcaggaagaagtaaccaacaatgcttctttcgttgaagacctgggcgcagattctcttgacaccgttgagctggtaatggctctggaagaagagtttgatactgagattccggacgaagaagctgagaaaatcaccaccgttcaggctgccattgattacatcaacggccaccaggcgtaagtgaacatctccaggcggtcgttcgaccgcctgagttttatctttttgtcccactagaatcattttccctccctggaggacaaccgtgtctaagcgtcgtgtagttgtgaccggactgggcatgttgtctcctgtcggcaataccgtagagtctacctggaaagctctccttgccggtcagagtggcatcagcctgatcgaccatttcgatactagcgcctatgcaacgaaatttgctggcttagtaaaggattttaactgtgatgacattatctcgcgcaaagaacagcgcaagatggatgccttcattcaatatggaattgtcgctggcgtacaggccatgcaggattctggccttgaagtgacggaagagaacgcaagccgtattggcgccgctatcggctccggtatcggtggtctcggtctgatcgaagaaaaccacagttcgctggtaaaaggcggaccgcgtaagattagcccgttctttgtcccgtcgacgattgttaacatggtagcaggccatctgactatcatgtatggcctgcgtgggccaagcatctctattgcgactgcctgtacttcaggcgtgcataacatcggccatgccgcgcgtatcatcgcctatggcgatgcggacgcgatggtggcaggtggcgcagaaaaagccagtacgccgctgggtgtaggtggttttggcgcagcgcgcgcgctgtcgacccgcaacgataacccacaggcggcgagccgtccgtgggataaagaacgcgatggttttgtactgggcgacggtgccggtatgttggtgcttgaagagtacgaacatgcaaaagcgcgtggtgcgaaaatctatgccgaaatcgtcggctttggtatgagcagcgatgcttaccatatgacgtcgccgccggaaaatggcgcaggcgctgcgctggcgatggttaacgcgttgcgtgatgccgcgattgagcctgctcagattggctacgtcaacgcgcacggcacgtcgacgcctgccggcgacaaagctgagacgcaggcggttaagtcagtctttggcgatgctgcaagccgagtgatggtgagctcgaccaaatcgatgaccggccatctgttgggcgccgcaggcgcagtagagtctattttctctattctggcgctgcgcgatcaggccattccgccaaccattaatctggataacccggatgaaggttgcgatctggacttcgtgccgcatgaagcgcgccaggtcagcgatctggagtacgctctgtgcaactcctttggttttggcggaactaacggttccttgatctttaaaaagatctaagttaagccagagacagacattaataaaaaggtccgcttgtcgggccttttttatcaggcatatcacctcttgttctgcgttattcatcctgccacactaacaggcgacggataaggagccactatgtttttaattaatggccatgcgcaggatcaacttgctgtaagcgaccgggcgacgcagttcggcgatggcagttttacgaccgcacgtattgttgatggcaacatttgccatctggaagcgcatcttcagcgcttgcaggttgcctgtgaaaaattacggatcgcttttagccattggtcgacccttcggcaagagatgacaatgttggccacagggcatgattcaggcgtgttgaaagtgatcattagccgtggtagcggcggccggggatacagcgccatgaattgtcaggcagctacccgaatcctctccgtttctgcttatcccgcttattattctcagtggcgtaagcaaggcatcactcttacccttagtcccataccgcttgggcgcaatccttatcttgccggattaaaacatctgaaccgcctcgaacaggtgttgattcgctctcatcttgagcagacggacgccgatgaggcgctggttcttgacagcgagggatgggttacggaatgctgtgcggctaatttgttctggcgtacaggcgacattgtttttacgccgcgtctggatcaggccggggtgaacggcattatgcgacaattttgtttacgccaactggcgcaatctcctttccaggttcttgaagtacaggcgagagaggaggcagtcaggcaggcggatgagattatcatctgcaacgcgctaatgccgattattcccatacgcgcctatcacgggacgtcgtattcttcgcgaacactgtttcaatttttagccccattttgtgagcatccgaattagttatgaaaaaattgtcaggcgttttccttctgctgttggttgtgctgggtattgccgtgggcgtggggatgtggaaagttcgccatctggcgaacagcacgttacttattaaagacgagactatctttacgctcaaggcgggaacggggcggctggcgcttggtgaccagctttatgatgaaaaaatcattaatcgcccccgggtatttcagtggctgctgcgcgtggagcctgagttatcacactttaaagcgggaacttaccgttttacgacggggatgaccgtacgggagatgcttgagttgctggagagcggcaaagaagcgcaattcccgttgcggtttgtggaagggatgcgccttagcgactacctgaaacagctacgagaggcgccgtatattcgccatacattgccggatgatgactacgccactgtcgctcaggcattaaagcttgcgcacccggaatgggtagaagggtggttctggcctgatacctggatgtataccgccaacaccagcgatgtcgctattctcaagcgagcgcatcaaaagatggtgaaagctgtcgatactgtctggaaaggtcgggccgaggggctgccttataaagatcagaaccaactggtgacaatggcctcgattattgaaaaagagacggctgtcgccagcgaacgcgatcaggtggcctcagtctttattaatcgcctgagaatcggtatgcgccttcagaccgatcccaccgtgatttacgggatggggacgagttataatggtaacttgtcgcgtgcggatctggaaaagccgacggcttataacacgtataccataaccgggctgccgccaggaccgattgcatcgcccagcgaagcgtcattgcaggcggcggcgcatccggcgaaaacgccgtatctctattttgtggccgacggtaaaggcggtcacacatttaacaccaatcttgccagccataatcggtcagtgcaggagtacctgaaagtgcttaaggaaaaaaatgggcagtaattatatcgtcatcgagggcctggaaggcgccggaaaaaccactgcgcgcgacgtggtggtggagacccttgagcaactgggtattcgtaatatgatttttacccgtgagccgggcggtacgcagcttgccgaaaaactaagaagtctggtgctggatattcgatcggtaggcgacgaagtgattaccgataaagcggaagtgctgatgttttatgccgctcgcgtacagctcgtcgaaacggtaatcaaacccgcgctggcgcaaggcgtatgggtgatcggcgatcgccacgatctctcgacccaggcgtatcaggggggagggcgcggcattgatcaaaccatgctggcgacactacgcgatgccgtgctgggcgattttcgtcctgacctgacgctgtatctggatgtcacgccggaagtcgggctaaaacgcgccagagcgcgcggcgatttggatcgcattgagcaggaatcttttgatttctttaaccggactcgcgcgcgctatctggaactggcggcgcaagactcgcgtatccgcaccattgacgcgacccagccgctggatgccgtcatgcgcgacattcgcgccacggtgacgaagtgggtgcaggagcaagcggcatgaaatggtatccatggttacggcccgcctatgaaaaactggtagaaagttaccaggcgggacgtgggcaccatgcgctactgattcaggccttacctggcatgggcgacgaggcgctgtgctatgcgctgagccgttatctgttatgccagcagcctgagggccacaaaagctgtgggcattgccgtggctgtcagcttatgcaggctggcacgcatccggactattacacgctgacgccggataaaggcaaaagcagcctcggcgtagatgcggtacgcgaggtcagcgagaaattgtacgagcactcccgtctgggcggcgcgaaggtggtgtggattgcggatgcggcgctattaaccgacgccgccgccaatgcgttgctcaaaacgctggaagagccgccggagcaaacctggtttttccttgccagcccggagcctgctcgtctgttggcgacattacgcagccgctgccggctgcatcatctggcgccgccgtccgaatcgtatgcgatgtcatggctgtcgcgagaagtgacggcgtcacaagaagcattgctcacggcgctacgtctgaatgcggggtcgcccggcgccgcgctggcgctgttgcagtctgaacgctgggcgcagcgtgaggcgctgtgtcaggcgttaatggacagtttgcatacgggcgactggtatgcggtattaacggcgctcaatcatgagcaagccccggcgcgcctgcactggctggcgacgctgctggtagacgcgctgaaacgtcagcacggcgcgtcgtacctgacaaacgttgatgcggacgcggttgttgccgcgctggcggggccgctatccccggcgcgtattcaggcaatcctgaacgatgtttgccattgtcgtgatcaattacttcatgtgaccggattaaaccgcgaactggtattaaccgatctcattctccgcatcgagcattacctgcaaccaggcaccttgttgcctgttcctcatctttgagagagacattatgtttttagtcgactcacactgccatcttgatggtctggattatcaatctttgcataaggacgtggacgatgtgctggcgaaagccgccgcgcgcgatgtgaagttctgtttagcggtggcgacgacgctgccggggtatcgccatatgcgcaagctggtgggcaagcgcgataatgtggtcttttcctgcggcgtgcatccgttaaatcaggatgaagcatatgacgtagaagaactgcgcctccttgctgcagaagacgatgtggtggcgatgggcgagaccgggcttgattacttttacacgcctgagaccaaaatccgccagcaggcgtcttttattcatcatatccagattggccgcgaattgcataaaccggtgattgtccatactcgcgacgcgcgtgccgatacgctggctatcctgcgcgaagaaaaagtgacggattgcggcggcgtactacactgttttacagaagacagagaaacggccggcaaattgttggatctggggttttatatctctttttccggcatcgtaacgttccgtaacgctgaacagttgcgtgatgcggcgcgctatgtgccgctggatcgattattagtcgagaccgattctccttatctggcaccggtgccgcatcgcggtaaagagaaccagcctgcgatggtacgcgacgtcgcagaatatatggcggtattgaaaggggttgccgttgaagaactggcgcagatcaccaccgataactttgctcgcctgttccatattgacgcgtctcgcctgtcatcaatccgttaaacgagtttttttaaagctcgtaattaataaacaaaacgcgtaaagttcaccgccacaaaaggggcggtgagcgagcttatggaaacattcggaaactcattttggcagaatgtgatactttttaggctatctggcgctgaaacgtgatagccgtcaaacaaaatcagacgtatttattttactctgtgtaataaataaaagggcacttagatgtcctgtccacggcggggttctcccccctcgccaatgcgtgagaacgtagaaaagcacaaatactcaggagcactctcaattatgtttaagaatgcatttgctaacctgcaaaaggtcggtaaatcgctgatgctgccggtatccgtactccctatcgcaggtatcctgctgggtgtcggttccgctaacttcagctggctgccagccgttgtatcgcacgttatggcagaagcgggcggatctgtttttgccaatatgccgctgattttcgctatcggcgtggcgttgggcttcaccaacaacgacggcgtttcggctctggcggcggtagtcgcgtatggcatcatggtgaaaaccatggctgtggttgcgccgctggttctgcatttacctgctgaagagatcgccgctaaacaccttgctgatacgggtgttctcggggggattatctccggtgcaatcgcagcgtatatgtttaaccgcttctaccgtatcaaactgcctgagtatctgggcttctttgcgggcaaacgcttcgtgccgatcatttcgggtctggccgctatttttaccggtgtggtgctgtctttcgtatggccgccaatcggtacggctatccaggcgttctcgcagtgggcggcttatcagaacccggttgtcgcgtttggtatttacggttttatcgagcgttgcctggtgccgtttggtctgcatcatatctggaacgttcctttccagatgcagatcggcgaatataccaacgcagcgggtcaggtattccacggcgacattccgcgctatatggcgggcgacccgacggcaggtatgttgtctggcggcttcctgttcaaaatgtacggtctgccggctgcggccattgctatctggcactctgctaaaccggaaaaccgcgcaaaagtgggcggtatcatgatttccgccgcgctgacctcgtttttgacgggtattaccgagcctatcgagttctccttcatgttcgtggcgccgatcctgtacattattcacgcgattctggcaggtctggcattcccgatctgtatcctgctggggatgcgtgacggtacgtcgttctcccacggtctgatcgactttatcgtgctgtccggtaacagcagcaaattgtggctgttcccgattgttggcgccggttatgcgattgtgtactacaccgtgttccgcgtgctgatcaaagcgttggatctgaaaacgccgggtcgtgaagacactactgatgacgcaaaagcgggggcgaccagcgaaatggcgccggctttggttgcggcgtttggcggtaaagagaacatcactaacctggatgcctgtatcacgcgtctgcgcgtgagcgtagccgatgtagcgaaagtggatcaggctggcctgaagaaactgggcgcggcaggcgttgtcgtcgcgggttccggcgttcaggctattttcggtacgaaatccgataacctgaaaacggaaatggatgagtacatccgtaacagctaagcagtaatgatgttggggagaattaaggcagccattcggctgccttttttaatggcgctttacatgccgctctccgacagtctgtcagaactgataattggcggtgaggctgacgttacgcggtgcgccgtaaacaatggaaccatcaatattggtgtcgtaggttttatcaaacaggttgttgatgtttccctgtacggagaaatttttcgtcacctgatagcgggtaaacagatcgaccagcgcatagctgccctgttcggcgcggaaagtgccgtacggcgtcgtggtatctttgtaaacccgattctgccagttcacgccgccgccgaccgtcagctccggtatcgccggcagacgatagcgggtgaataacttcacgctggtgcgcggaagattagggttcacggcgttaccttcattgtcctcggcaacataccgggtagccccgaaagtcatctgccagttatcggtaattgcgccgttcacttcaaattcgacgcctttgctcaccgttccgtcagtagacttccaggcaaactccccattactgccagggatgggaatagtggttgcctgagcgacgttattctgctcaatgcggaacacggacaacgtggtggtgaggcgactgttcatccagtcggacttcagacccgcttcatagttattaccggtaatcggagccagatattgacccgctttgtcgcgtttattctgcggctgaaagatagaggtataactggcataagcggaccagttgtcgttgatatcataaatcagcccggcatacggcgtggtatggtttttctccatgctgtaggtcagtgtatcaacacgccagttggtataacgagcgccgagaatcagatgcagcgggtcggccagcgaaatgcgcgtagcggcatacagcgatttcatatgcgtggtatcgtcctgcgccagattttgtggcgcccagtgggtttgggggaaattaccgttaaaggcgctgaagttgccaatgtcgtccggaaagacgttcgcccaggcgctaaaatagcggttattctgtttactataactgccgccaaacatcatattgtgctgacggccaaacagctcataagcgccatcggcaaagagatctatggcatctactttgcgcttgccgctgttccagcccgtaccgccgaccacggggtagcttgcgccataaggactcaccagcgtacctgtctctttatcgactaacgcatcgatatacatcattttactgtcgaatttgacctcagtatgggtcgcattcagggtcgcctgccagctttcggcaaaacgctgtttaagcgtgacgaagaatttatttatctctttgttgttataagcccagtccggggcggtactacgcgcgcggtcatagctatttttgctgccatcggtgttccagcgcggcagaccgccccaggttgggctgttgacatcaattttttgatattcataaccggctgaaaggttggtggttgtacccagatcggcatcgacaattccggaaaagaacgctttctcactgttatagcggtccagccaggaatcattattctgataacccgccacgatgcgcccacggacattaccgtctgcggtgagcggactttgcagatccatgacgtaacgctgcttattccagctaccgtattctgtggagacgttacctttgaactcccgactggtggcgtgtttacggatcatattaattgaggcagaaggattaccggtcccggtcatcagcccattcgcgccgcgaaccacctccacgcgctcatacagcgcggtatccgttagcgcatcgcccagattccagcgggactcaaaatacgttggaataccgtcaaccatatagttgtcaatttcaaacccgcgcgagtaatagctgatgcgatcggagtcagcctgacttccgctgatccccagcgtattggtcatcacctcgcccagggtttgcaactgctggtcttccatacgctgctggctgacaatactgaccgactgcgggatatcgcgctgagtcatcggcattttggtgcccgctgcggtcgttttcatgctgtaatcctgttcttcacggtttacggcgtcagcggtcgtctcgccttcgacaataacggtatcctcagccgcgaaggcggcaggcataaatgccatcgccatacccatagctaacagcgacggtgcggcggtggacggaaggtgtttgtcccggcggtattgaatgaaagacatctgaaaatccttgcttgttattggggtaagttcaggacgtatgacgttgaaccttttcattctttgctagttaatgcgcataaaaatgcaaatgagaaatatacgcatttgtattaaatgtgtaaaacggtataaccagggaaactagaaatattttttaagcgtacaaaggcgtcatggctgggggatatggcggtaagtccagcatgtagtcatttttcgcttaataaatcgtgggttaaagttgaaagagcgtcggtaactcgctcatactctatactcgcagtatggctcggcgtagcatgtgcgctgcaagggctattatgaaaaaggaaaacgtcgtggcagaagaaactatattcagcaaaattattcgtcgtgaaatcccttcggatatcgtttatcaggatgagctggtcaccgcctttcgtgatatttcaccgcaggcgccgacgcatatcttgattattcccaatatcctgatcccaaccgtcaatgacgtgacggcggaacatgaacaggcgttaggtcggatgatcaccgtggcggcgaaaatcgccgaacaggaaggcattgccgaagatgggtatcgtttaatcatgaataccaaccgtcatgggggccaggaggtttatcatatccatatgcacctactgggcggccgcccgctaggcccgatgctggcgcataaaggcttgtaagtatgatcaaaggatgcatcgcggtttctctgggcttgctgctgcttaccggctgccggtcacaccctgaaattccggtaagcgacgcgcagtcgctggtgatggagtccacggttctggcggcgggcgtcaccgcagagccgcctgaactgacggcgtctgatatccagccatcagcctcttcccgcgtctataacgaaaggcaagagcccataaccgttcattatcggttttactggtatgacgcgcgggggctggagatgcatccgctggaggcgccgcgtagcgtaaccatacccgcgcgttcgtcggtaacgctatttggcagcgccaattatctgggggcgcataaggtcaggctttatctttatttgtgaggagtgaattttgatgacaaaaatgcatcgctacgctgccattgctgcgctggcgatatttctctccgggtgtatggcgcaacgtcaacctgcgccagttgaagaggtaaaaccagcgccagaacaacccgcgcagccgccgcagcctcctgttgtgccgtctgtgccaacgattccacagcaaccggggccgatcgaacatgaagatcaaacgggccagccagcgcctaaggtgcgccactatgactggaacggcgcgatgcaaccgctggtcagcaaaatgttgcaggctgatggcgtgacggccggaagcgtattgcttgttgacagcgtgaataaccggacgaatgggtcgttaaatgcgaacgaggcaacggaaacgttacgtaatgcgctggcgaacaacggtaaatttacgctggtgtccgtacagcaactctcgatggcaaaacagcagttaggattgtctccgcaggatagtctgggaacgcgcagtaaagctattggcattgcgcgcaatgtcggggcgcaatatgtactttactccagcgcatccggtaacgttaacgcgcctgcattacagatgcagttaatgctggtgcaaactggcgagataatctggtcaggtaaaggtgcggtccaacaacaataatcccttaacgcgcgacgagatcctgtcgcgctattttccccagtatcgtcccgccgtcgccacatcgcaggggctaagcggcgggagctgtattattgcccacgatactcaccgtgtcgtgctgcgccgtcatcacgaccctgacgctccaccagcccattttttacgtcattaccgcgccttatcccaattgccggccagtcttgcgccgcgagcgcttttttatactccaggctggatggcggtagaatatctgcatggtgtggtaaattccgctctgccagatgccgacgaactggcggccttactgtatcatttgcatcaacagccgcgttttggctggcgtatcgcgctatcgccactattggcgcagtactggtcgtgttgcgatccggcaaggcgtacgccgttttggttgcggcggctcaaacagttgcaaaaaaacggtgaacctcgcccgcttcggctcgcgcctttgcatatggatgtccatggcgacaatatagtattaacgtccgccgggttgagactgattgactgggagtatgccggcgacggcgatattgcgttggagctggcggcagtatgggttgaggatgaacgccagcaccgacaactggcagacgcttatgccgcgcgcgcgcgaatcgacgcccggcagctatggcgacagatacgattatggcacccctgggtcattatgctaaaagcagggtggttcgaataccgctggcgacaaaccggcgagcaacaatttatcaggctggccgatgaaacctggcgccagctacgtatgaaaggataaggagagcagtgtgggcccagtaatgttgaatgtcgaaggatgtgagctggatgcggaggagcgcgagatactggcgcatccgctggttggcgggcttattctgttcacgcgtaattaccatgacccggaacagttgcgcgaattagtgcgccagattcgggcggcatcgcgtaaccatctggtggtggccgtcgatcaggaaggcgggcgcgtacagcgtttccgtgaagggtttacccgcctgcccgcggcgcaatctttttttgcgctgcatgggctggaagagggggggcgactggcgcaggaggcagggtggctgatggccagcgaaatgatcgcgatggatattgatatcagttttgcgccagtgctggatgtcgggcatatcagcgcggcaattggcgagcgttcttatcatgccgatccagcaaaagcgttggcaatggcaacgcgctttattgacggcatgcatgacgccgggatgaaaacgaccggtaagcatttccccggccacggcgcggtcacggcggactcccacaaagagacgccgtgcgatccacgtcctgaaacggacatccgtggcaaagatatgtcggtgttccgcacgctgattagcgagaataaactggatgcgattatgcctgcccacgtgatctaccgcgctatcgatccgcgtccggcaagcggttcgccgtactggctgaaaacggtgctgcgtcaggagttaggctttgatggcgtcattttctccgacgatctgtcgatggagggcgcggcgattatgggcagctatgctgagcgcgctcaggcgtcgctggatgcgggttgcgatatgattctggtctgcaataatcgtaaaggcgcagtcagcgtgctggataatctgtcgccgatcaaagcagaacgtgttacacgtttgtatcataaaggttcattttcacgccgggagctcatggactcagcacgctggaaaacagccagcgcccagctcaaccagttacatgaacgctggcaggaagaaaaagcaggtcattaactcgagttttcgtgagggtgccagatgattatttatttacacggttttgattcaaatagtccgggcaaccatgaaaaagtgttgcaattacagtttatcgacccggatgttcggctggtaagctacagtacgcggcatcctaagcacgatatgcagcatctgctgaaagaagtggacaaaatgttgcagttgaatgtggacgagcgccctttaatctgtggcgtggggctgggcggttactgggcggagcggattggctttttgtgcgatatccgtcaggtggtttttaacccgaacctgttcccctatgaaaacatggaggggaaaatcgatcgcccggaagaatatgcggacatcgctacaaagtgcgtgaccaactttcgcgaaaaaaatcgcgatcgttgtctggtgatcctctcgcgtcatgacgaagcgctggacagccaacgctcagcgcaagcgcttcacccgttttatgaaattgtgtgggatgaggaacagactcacaaattcaaaaatatttcgccgcatttgcaacgtatcaaagcgtttaaaacgctgggataacgccatccggcaatatggcgttatcagtgaccggataaccagccttgcggctggtttttttatgctcaattctcgcaaactgtctatcttttcagcatgaaaacttgatgcacatcaattttggtatgaccaatgcaccgttcatgctattctcatatcagaagcttattctcattaacgtaacttgttgttaattaaaggctatgctaataacttttaattaacaattggttaataaatttaagggggtcacgttgactacaccattaaaaaagatcgtgattgtcggcggcggcgctggcgggctggaaatggcgacgcagttaggccataaactggggcgcaagaaaaaagcgaaaatcacgctggtagacagaaatcacagccatctgtggaaaccattgctgcacgaagtggcgactggctctctggacgaaggcgtggatgcgctgagctatctggctcatgcgcgtaatcatggtttccagttccagctggggtcggtgatggatatcgatcgcgaagcgaaaaccatcaccattgccgagttgcgtgatgaaaagggcgaactgctggtgccggagcgcaaaatcgcgtatgacacgctggtgatggcgctgggcagcacctctaatgatttcaacacgccgggcgtgaaagagcactgtatcttcctcgataacccgcatcaggcgcgccgttttcaccaggagatgctgaacctgttcctcaagtattcggctaatctgggcgcgaacggtaaggtcaatatcgccatcgttggcggcggtgcgacgggggttgagctgtcggctgaactgcataatgcggtaaaacagctgcatagctatggttataaggggctgaccaacgacgcgctgaacgtgacgttggttgaggctggcgagcgtattctgcctgcgttgccgccgcgtatctccagcgccgcgcataatgaactgaccaaactgggcgttcgcgtgctgacgcaaactatggtcaccagcgccgacgaaggcggtctgcatacgaaagaaggtgaatatattcaggccgatctgatggtgtgggcggcgggtatcaaagcgccagattttatgaaagagattggtggtctggaaacgaaccgcattaaccaactggtggtggaaccgacgctgcaaaccacgcgcgatcctgatatttatgcgattggcgactgcgcttcctgcgcacgtccggagggaggttttgtgccgcctcgcgctcaggcggcgcatcagatggctacctgcgcgatgaaaaacattctggcgcagatgaatggcaaaccgctgaaagcttaccagtataaagatcatggatcgctggtctctctgtccaacttctctaccgtgggtagtctgatggggaacctgacccgcggttcaatgatgattgaaggacgtatcgcccgcttcgtgtatatctcgctataccgtatgcaccagatagcgctgcatggatactttaaaaccggcctgatgatgctggtgggcagtattaaccgcgtcattcgtccgcgcctgaaactgcattaatttctctgcgtctcaccggctgctcgcgccggtgagcgcttctccatcactcgcttcggagttgtccgaatccttcagctttaccgcctcatcccgcatttttcatcctcattccgattggctttgttcgcatactggttgcaaaattgttaccaatagcaacgaaggaggaactcccgtgaataaatcaatgttggcgggtatagggattggcgtagcggctgcgctgggtgtggcggcagtggccagtctcaacgtatttgatcgtggtccgcaatatgcgcaggtgatatcggctaaaccgattaaagagacggtaaaaacgccgcgtcaggagtgccgtaatgtcacggtcacgcatcgcagaccggttcaggacgaaaaccgtattgccggctcggtgcttggcgcagtagcaggcggcgtgattggacatcaatttggcggcggtcgtggtaaagatgtggcgacggtcgtcggggcgctgggcggcggttatgctggcaatcaaatccagggatcaatgcaagaaagtgatacttacactaccacgcagcaacgctgtaagacggtgtatgacaaatctgaaaagatgcttggctacgacgtgacctacaaaattggcgatcagcagggcaaaatccgcatggataaagaccccggaacgcaaattcccctcgacggcaatggccaactggttctgaataacaaagcataaaaaagctgtactctgcaagttagcccctcattcgctcaggctgaggggcttttttttatccgaagccgcgtcgttcaggacttgatcagttcaggccagatgcgcagagtcgtacgcgtaatttgcatcagttgttcgaaggtggcaccttcacgggcgctgatcgacattccctgtaaaatacagtttatatattctgcgagcgcctgcgggttacagtgcgccggaatttcaccgcgctcctgacgttggcgcagaaactggatgagcgtctgttcctgcatggcgtggcgtgattttaccgtgcgggcgatatcgcgcgaggaggcggccagggtggcggacgtattaatcataaagcagccagccggcgtgtctgtactggtaaagcaggcggcaatttctgtgaagtaatcttccagcgccgattctacgcttttctcttcacaaaagagctgggcttcgtgttttgaggcaaagcgagtgatgtagcgatccaggacagcgcgaaataatccttttttgttagtgaattccgcatagagagtaggcgctttcgccccggtagcctctacgagatcggcaagcgaagttgcttcatagccgtgctgccagaagagagtcatggccttatcaagcgcggcttccctgtcgaacacttttggtcggccacggcttttcttcgcgcaactcgtggtatccgttgtcatgatgccgttgtacctgtttaaagagcggtctctctattataaaaacaaaccacttctggctccagagtattcattagaaaaataaatcaattctattcacatgaaaaataacatctttataaattatataacgatcattataaaaagaggttgacgtgtgatgtagatcacatctatgattaacttatcgatcgttaagttaatgcttacgacacccattcatctgctaaaggtcatcactatgaaaaacgtaaaaaccctcatcgctgctgccgtactgagttcgctctcattcgccagcttcgccgccgttgaagttcaggcaacgccagaaggtcaacagaagttcggcaccatttccgcgaatggcggcacgaatctgggctcgctggaagatcagctggcgcaaaaagcgcaggagatgggggcgaagtctttccgtattacctctgttaccggcccgaataccctccacggtacggcggtaatctataagtaagcattaaccctcattaatgccgctgcgattgccacaataaaaagaaaaagcctcgcgatgcatcgcgaggcttttttgtcggtcagctattcacgcttacagcgactgcggtttcgcctctgcttgacgggttacatccaccggcattccggaacgcacttccataacatgttccatcaccgcagcatcggtctgcggcgcgtccttaaaggcctgcatcgggccattcagcacaatcggcaacacctgcggatcgtcgcctatatttttagacagcggctgatgaacttccaccagtcgcacgccgcctggctccaccgaggctttaatcggcgtattgataatattcactttggttcccggcgtgacctgacggaacaatgtctctatatcaccgtcgcgcagacggatacagccggaactgacgcgcataccaatgccaaaatcggcattcgtgccatgtaacagatagacgccgccgtaggccgctaaacgaatcgcgtgatgtcccattgggttatcgggaccggcaggcaccacggcggggagatcgataccttgcgctttataacgggcgcgaatattggcggtcggcgtccaggttggattggcgcgtttatccgaaatggtcgtcaccatcgttggcgtcagggtatcgccgcccagttggccaatcccgatagggtagaccgtgaccgtatttttccccggttgataatagtaaagccgtaattccgcgaggttaatgacgataccttcacgtggcgcgtccggtagcagcgtttgcagcggaatcgttagcacgctgcctgcgcgtggcacataaggatcaatgccggggttggcctgtaacagggctaaaaagcccacgttatattttttggcgatcgcctccagcgagccgccgtcgtcttcaacgacatggaatttattttctcccaccagtcgactgccggggggcggaagaggccacgtattcgcctgcgcgggaagggcaagcatgatggtcgcggtaagcgcaagcaacgcccaccagcgagagagtcgcgtattgttgaacattataataaacccatgattattatgtggttatttttataaaagaggaaataagaattatggcggttggctgtgtctggaactgcagggaagtgcaaagaatttgtaaagattaggccggacgcagagtaatgacgcccggcctgacgcttatgcaatagcgttttcttccagttgctgcataaactggcgtacccagtctatacgcgttttacgttcgcttaaatcctgaataaacttgaggcgcgtcgggccatccagacggaaatgctgcggctgtttttgcagcaacccgataagccaggcggggtcaacgtggtttttctcggcgaactcaatcgttccgcctttctcgttaccctccagttttcggatgccgagcttttgcgcctgttggcgcaggcgggcgatatccagcagattacgcgccggatcgggcagcaggccgaagcggtcgatcaattccactttgatctcctccagctcgttttcgttcttcgcgctggcaatgcgtttatagaatgacagccgggtattaacatccggaataaaatcatccggcagtaacgacggcattcgcagctcgacttccgtttgctgactggtgagatcttccagcgagggttcgcggcctgctttcagcgcatcaacggcgttttccagcaattccatgtagagtgagaagccgatggtttccattgagccgctttgctcttcgccaagcagttcgcccgcgccgcggatctccagatcgtgggtcgccagcgcaaacccggcgcctaaatcctccagcgacgcaatcgcctccagccgtttttgcgcatcggtggtcatggccttaggatgtggcgtcaacagccaggcgtaggcctggtggtgcgagcgcccaacgcggccacgcagctggtgcaactgcgcgaggccgaaatgatccgcgcgttcaatgatgatcgtgttagcggtgggaatgtcgatccccgtttcgataatggtagtacacaccagcacgttaaaacgttgatggtggaaatcgttcatgacccgttccagctcacgttcgcgcatctgcccgtggcctatagcgattcgcgcttccggcaccagttccgccagccgctctgcggctttctgaatattttcgacgtcattgtacaaatagtaaacctgaccgccgcgcaggatttcacgcagaatcgcttcccttaccaccaggctatcatactcgcggacaaaggtttttaccgccagacgacgggcagggggggtggcgataatggagagatcgcgcataccgctcatcgccatattcagcgtccgcgggatcggcgtcgccgtgagcgtcagaatatcgacatcggcgcgcatcgccttaattcgctctttgtggcgcacgccgaaacgatgctcttcatcgacaatcagcaggccgaggtcgcgcagcttcacatcgctttgtagcagtttatgcgtaccgatcagaatatcgatcttaccctcggcggcttccgccaggatttgtgtctgctctttggcgctgcgaaagcgggacagcatctcaatgcgtaccggccagttggcgaaacggtcgcggaagttgtcatagtgttgctgcgccagcagcgtagtcggcaccagtaccgctacttgtttatggttttccactgccaggaacgcggcgcgcatcgccacttcggttttgccgaagccgacgtcgccgcacaccagcctgtccatcgccagcggttggcacatatcgctcaatacggcgttaatcgcctgtgcctgatcgggcgtcgtttcaaacgggaagctgtcgcagaataactgatactgctcacgatcatgcttaaaggcaaaaccctcttttgccgcccgttgcgcataaatatccaacagttccgctgcgacatcgcgcactttttccgccgctttctgccgggcgcgcgaccaggcgtcgccgcccagtttatgcagaggcgcactttcttccgcgccgccggcatagcggctaatcagatgcaatgaggagaccggcacatacagtttggcgtcattggcgtaggtgagcatcagatactcacccttgatgccgccagcctccagagtggtcatgccggcatagcgtccgacgccgtgctccagatgcactaccggctgaccgacgtggagctccgccaggttacgaatcaacgtatccgggttgatcgtgcggcgggaatccaggcggcgacgcgccacccgctcacccaaaagatcgctttcacaaatcagcgccagattgcgttgggtgtcgataaagccatgttctgcggcgccaatcatcagatagcgtcccgcatcctgcgcctcgtccaggcgtaatatccgcttcggcgcgatttttatgcgagccaggagctctcccagagcttcgcggcgtccttcgctttccacagaaaaaatcaccggaccgctgaaagattcgaggaacttacgcagcgcgtccagcggcgctttctgctgcgcctggatagccaaatccggtaatttctggaaaccgagattggtattggcggctttttccggcagatggtcggttttaagctggaggcgaggccagcgtttaagctcggaaaagagctcatccacccgtagccagagggcttccggcggcaaaagcgggcgcataggatcgacgccacgattttcaaaacgcgccagcgtatcggcctgaaagcgttcggcgctggtttccagcgagccggtattcaccaccagagtattggcggggaaatagctaaataatggcggtaacggttcgctgaaaaagagcggctgccagtattcgatcccggcgggcagagtgcctttgctgacctgctgatagatgtgctcggcgtcgcgttttacctcaaaggtatcgcgccactggctacggaaaagctcaatagcggctttgtcggtaggaaattcgtgcgcgggcaacaaattgatggcctcgacctcctccagcgtacgctgggtatccgcgtcaaacagacgcaggctgtcgatttcatcatcaaaaaagtcgaggcgataaggctgttcgctgcccatcggaaagagatccaacagcgcgccgcgcgtcgcgtattcgccatgctccatcacctgatcgacatgccgataaccggcgctgtcaagctgcgcgcgcagagcgtcgcgggacagccgctggccttttttcatcaccagcgcatgaccatgcagatagctatgcggacaaacgcgctgcatcagggtgtttaccggtacaatcaagacgccgcgctgcatcgacggcaactggtagagcgtggacaggcgcgaagagataatttcctgatgcggggagaagctgtcatacggtagcgtttcccagtccgccaggttcatcaccatctgatcggtaaactggcggatttcatcatgcaatcgcagagcattttgcatgtcaggcgctatgagtaccaccggaccggcatggcgttcggctatctccgccaccagcgtagcgcaggcggcaccggtaagttcgcccaactggcgctgatcgcccgcttttgtcggcagcgtgtaacgttgtttttcaggcataacggttgtcagtatctctttttgttttacgccgcactctacgcgtcacccttcaggctgcttcatggttggctgcacgccgggacagcatgaaggactcaggtattcaggggcatatgactgataagcaatgttctttattatccgcgatcgttgtttattagcaaattgaatccgccgcataacgcgccgaacaggtaaagtatgaacatgtaagtgacttgatttgtcggcctttttcagaataacgctgacgaactcttacggttcagacatttacgcattccgctttcgcttatatactcgggactttgctaacagcaaccagacggattacatgtatcaacctgtcgctctattcattggcctgcgttacatgcgcgggcgtgcagcagatcgcttcggtcgcttcgtttcctggctttccactatcggcattaccctgggggtgatggcgctggtcacggtattgtcggtgatgaacggttttgagcgcgaactgcaaaataacattcttggtttgatgcctcaggccatcctctctgctgaacatggttctcttaacccgaatcagatgccggaaaaagcggtgaatctgcaaggcgttaaccgtattgcgccgctgacgacgggcgatgtcgtactgcaaagcgcgcgtagcgttgcggttggcgtgatgttaggtatcgatccggcgcaaaaagatccattaacgccgtatctggtcaatgtgaagcaaagcgaattacagccgggtaagtataatgtcatcctcggcgagcagctcgccggacagttaggggtcaaccgcggcgatcagattcggctaatggtgccatctgccagccagtttacgccaatgggacgcctgcccagccagcgtctgtttacggtgattggcacatttgccgccaatagcgaggtcgatggctatgaaatgctggtcaatattcaggacgcgtcgcgtttaatgcgctatccggcaggcaatattaccggctggcgtctgtggctggatgaaccgctgcaagtcgataccctcagccaacagacgctgccgcaaggcacgaagtggcaggactggcgcgaacgcaaaggcgagttgttccaggctgtgcgcatggaaaagaacatgatgggattgttgctgagcctcatcgtggcggtcgcggcttttaacattattacttcgttgggcctgatggttatggagaagcagggtgaagtggcgattttacaaactcaagggctgacgccgcgacaaattatgatggtctttatggtgcagggcgccagcgccgggattatcggcgcgctgttgggcgccgcgctgggcgcattgcttgccagccaactgaataacctgatgccgatcatcggcgcgtttctggatggcgctgcgttgcccgtggcgatagagccgttacaggtgatcgttatcgcgctggtggcaatggccatcgcgctgctttctacgctttatccttcctggcgcgctgccgccactcaacccgctgaggctttacgttatgaataagatcctgttgcaatgcgacaacctgtgcaaacgctatcaggaaggcaccgtacaaaccgacgtgttgcacgatgtcagcttcagtatcggcgaaggcgaaatgatggcgatcgtcggcagttccggttcgggtaaaagtacgttgctgcatctgttaggcgggctggatacgcccacctccggcgatgtgatttttagcggccagccgatgagcaaactctcttctgcggcaaaagcggaattacgtaaccagaaactggggtttatctatcagtttcatcatctcctgccggattttacggcgctggaaaacgtggcgatgccattattgattggcaaaaagaaaccggcggagattgacgctcgggcgcgagaaatgctgcacgccgtagggctggagcatcgcgcaacccatcgaccttcggaactttccggcggtgagcgccagcgtgtcgcgatagcgcgcgcgttggtgaataacccgcgtctggtgctggcggatgagccgaccggtaatctcgatgcgcgtaatgccgacagtatttttgagcttctgggcgagttaaatcgtctgcagggaaccgcgtttctggtggtgactcacgatttgcaactggcgaaacgtatgagccgccagcttgagatgcgcgatggccgcctgacggcggaactgagcctgatgggggctgagtaatggcgtcgcctttatcattgttaattggcttgcgtttcagccgtggacggcggcgcggcggtatggtttcgctcatttccgtcatttctaccatcggtatcgcgctgggcgtggcggtgttgattgtcggtttaagcgcgatgaacggtttcgaacgcgagttgaataaccgtattctggcggtggttccgcacggggagattgaagcggtcaatcagccgtggaccaactggcgtgaagcgctggcaaaagtgcagaaggtgccaggcattgccgccgccgcgccgtatatcaattttaccggcctggtagagagcggggccaatttgcgcgccattcaggttaaaggcgtcgaccctaagcaagagcagcagcttagcgcgttaccgtcatttgtgcaaaatcacgcctgggatcatttcaaagcgggcgagcagcagatcattatcggtaaaggcgtcgccgatgcgctgaacgtgaaacagggcgactgggtgtccatcatgatccccaatgcgaatgccgaccataagctgctccagcccaaacgcgtgcgtttgcatgtcatcgggattctgcaactgagcggccagctcgatcacagcttcgccatgatcccgcttgaggatgcgcagcagtatctggatatggggtccagcgtttccggtatcgcgcttaaagtccacgacgtgtttaatgcgaacaaactggtgcgtgacgcgggtgaagtgactaacagctatgtctacattaagagctggatcggcacctacggctatatgtatcgcgatatccagatgattcgcgccattatgtatctggcgatgattctggtgatcggcgtggcctgttttaatatcgtttccaccttagtgatggcggtaaaagacaaaagcggcgacattgcggtattaagaacgctgggggcgaaagatggtttgattcgtgccattttcgtctggtacgggctactggcgggcttgctgggcagcttgattggcgtggcgatcggcgttgtcgtttcgcttcagcttaccgccattattaatgggattgaaaaggcgatcgggcatcagtttttgtccggcgatatctattttatcgacttcctgccatccgaattacattggctggacgttgtttacgtactggtcacagcgttgttgttaagcttactggcgagctggtatccggcgcggcgggcgagcaacattgaccctgcgcgagtattgagcggccagtaatcgcggaatataaaaacaaggagcggtgatgtattacgggtttgacattggcggaacaaagattgcgttaggcgtatttgactcaacgcggcggctgcagtgggaaaaacgggttcccacgccccataccagctatagcgcctttttagacgccgtatgcgaactggtcgaggaagccgaccagcgatttggcgtaaaagggtcggtagggattggcatacccggtatgccggaaaccgaagacggcacgctgtacgccgcgaatgtcccggcagccagcggtaagccgttgcgcgccgatctcagcgcccgactggatcgcgatgtgcgtctggacaatgacgctaactgttttgccttgtccgaagcctgggatgatgaattcacgcaatatcctttggttatggggcttatcctcggcaccggcgtcggcggtggcctggtgctaaacgggaagccgattaccggtcagagctatatcaccggcgagtttggtcatatgcgtttgccggttgacgcgctaacgttgatggggtttgattttcctctccgccgttgtggatgcggtcagatgggctgcattgagaattatctgtccgggcgcgggtttgcgtggctatatcagcattattatgatcaatcgctgcaggcgccggagattatcgcgttgtgggagcagggcgatgagcaggcgcacgcgcatgttgagcgctatctggatttactggcggtttgtctggggaatatactgacgattgtcgatcccgatttattggtgatcggcggcggactatcgaactttacggcaataacaacgcaactggcggaaagactgccgcgccatctcctccctgttgcccgcgcgccgcgcattgagcgtgcgcggcatggggatgcaggtgggatgcgcggtgctgcttttttacatcttaccgactaatcaaaaaaagaggttgttatgcagtcgcgtcggtttcatcgattaagccgctttcgtaaaaataaacgtctgttgcgtgaacgtctgcgccagcggatctttttcagagacagagtggtgccggaaatgatggaaaacccaagagtattagtccttacaggtgcaggaatttctgcagagtctggtattcgtacgtttcgcgcggcggatggcctttgggaagagcatcgggttgaagacgtggcaacgccggaaggattcgcccgtaatccggggctggtgcagacattttataatgcccgccgtcagcagcttcaacagccggaaatacaacccaatgcggcgcatctggcgttagcgaagcttgaagaagcgcttggcgatcgctttttgctggtgacgcaaaacatcgacaatttgcatgaacgcgcgggcaatcgcaacatcattcatatgcatggcgagctgttgaaggtgcgctgttcgcaaagcggccagattctggaatggaacggcgatgtgatgccggaagataaatgtcactgctgtcagttcccggcgccgctacgtccgcacgtggtgtggtttggcgagatgccgcttggcatggatgaaatttatatggcgctgtcgatggcggatatttttatcgccattggcacgtccggtcatgtctatccggctgcgggttttgtgcatgaagcaaaactgcacggcgcacatacggtggaactgaatcttgagccaagccaagtcggcagcgagtttgaagagaagcactacggcccggcaagccaggttgtgccggaatttgttgataaattcctgaaagggctgtagtgctgtttgcccggtaacgccttatccggcctacatttcacgttacgttcatctgtaggcccgacaggcgctttggctgaattagcgtcctgcttttagcttctgataatactcttcataaatggcgctggcgtcgccgacatcgttttgccactcgcctttgctgatggtttgcgcatccggatagagcgacttatcattggcgacctccgggcttaacagcttacgcgccgccaggttgggggtagggtagccgatggtttctgccacctctttcgcgacgtcaggacgcagcaggaagttgattagcttcagcgcgccctctttatttttcgcgtttgccggaatagccaggctatccatccagaaaataccgccttctttcggccagacgacctccagcggcgtgccagcctgacgagcaacgaaggccgaaccgttccacaccatccccagattgacttccccttccatatacggattcgccggattatcggagttgaaggccgctacgttcggcatcagttttttcaactcttcatatgccgcttcgatctctttcggatcggtagtgttaccggaataacctagcttgcgcagcgccatctggaagacttctcgcgcatcgtcggttaaaagcaggctgtttttatattccggtttccacaagtcagcccagctggtaatggtttttggatcgatagcatcgctgttcacgccaatcgccgttgcgccccagatatacggaacagaataatcgttgttggggtcaaacggtttgttgagcatttccggatcgaggttgtggaaattggttaatttcgacttatcgatcttctggatcatgccttctttgcgcattttgtcgacatagtatgtagaaggaacaaccaggtcatacgcgccatctttataggttttgagtttggcatacatggtttcgttcgactcgtaggtcgaataaatcaccttaatgccagtctctttagtgaactgttccagcaggcccggcggcacatactcagtccagttatagaaatagagcgtgtcgttgtcggaggcatgagcggcactcatacccagcgccagggcgcccgccgcgagcaggtggcgtgaccattttttcatttaacgtcccctgaattacgggccttatcggcccttggttttatcacgagcaataagctggctggcaatgaccattaccagagacagcaccaataaaacggtcgccagcgcgttcacttctggtgaaacgccgacttttaccatggaataaatctttaagggtaaaatttcatagcccggcccggtgacaaacgacgagaccactacatcgtccatcgacaacgtaaagctcagcaaccagcccgccgccaccgccggcatcgccagcggcagaatgattttgcgtaaaatcgttacctcactggcccccaggtcttttgcggcttccagcattctgacatcaaagcctttcaggcgcgaatagaccgtgacgaccacaaacggcaggctaaaggtgatgtgcgagaacagcaacgaccaaaagcccagttgaatgccgagtaacataaacagcaccagcagggagatcgccatcacgatatccggcgacatcattactacaaacagcatcccgctgacgaatggcttcccgcgaaagcggtagcgataaagcgccaccgcggttaacgagccaatcaacgtggcgaaggtcgctgaaaaaatcgccatcgtcagtgaatgttgagcggcctgcaacagactgtcgttattgactaggagttcgtaccatttagtggtaaagccctgccagttaatgccgaaccgcgaactgttgaaggagttcacgatcagaataatgatgggaatatacagatacgcatagatggcagtcatgaaaccgccacggagcagccgaccgatcattcaagttccaccttcttattcagaggatggggtgcttttagagtattgaaaatgatcaattttttctcttctccaaaatctctccaaaacgtctcgcggttatcagcagccaggaagaagcaagctgccgcttgaagccgcgaattttacaacaaattgccagacgagcgggaaaaaaaggccatttaaatgactattctcatccgatccggtcatatgcggcattattgtgcctggcaagaggttactcagtaggcaaacaggaagtacgtgagtaaaccctgaacgtgacgtctgagaaagcgtcgtctgattttataaaaaacaacataaacagccgctttgttgttctgagcgaacgtgtagcgtggttaactgttcttccgccattttttgtatagcctgggggtctattctaaaaatggcgtgaaaaacctgatcagagatggcttcgactatctcagctaacatactttggctggtgctgggatccgttacgaggaacgcctgaaacgtcttatccgctagtaaaacctcttttaccattttttcaataggtatgtgggtatgcggtggtggtatttcaagctgttttaatccacacatcgccattgtttctaaaaatgcgttttgctgagtactttcggatatattcgcatggtgtaaaatgcgcgttgtcttttcaatcccagactgaattttcgctgccaggtaggttgccttttcttgcgctttccacccatctaaatgtccttttctcaattcagtatataaatacccctctatgttgtctaatggaaccgataatatcggcgcgccagcaggattgagacataatgtcgaagggagggggtagtctacgatttcgctatatcttctcttaatcatggccgtcatttgtggatgcgattttaaaatatccgggcgatctttcattaaaaaataaagattccccatgacttcacagctaaaggtatcggtattttgagtgatacgtaacaattcgttctcttcgttttgatccatgatgcgaagaataatggtggcatcattttcatgaggattatgaacctgaaatctatctctttgcgatgcgcaggctaactctttcaactcaaaaaaaatctctgtaagccgctctcgtgtgggggcgcgttcggcaaacaacatctcatgtagacaacggtccgcttttgctttgccagtagaaaaaaagaagtctttaattttttcccataaaactttccaccatgcttctttcgtattccttggggagttggtaaggatttcactttttaaaaaaccattccctatagtaatcggcatattaatctcacttatactggagtaaaaatgactacataattgattaaatcgaccctttttatctcaactgcgggcgcatcggatgtaatataatttttaaaagagactggcaatcagtataaaacctgagagcttcgcgtataaacgcattactgtctgtgatagcgtcgctacaggtaaaaataaaagaaggactaccgcggatgatgttgtagatttgcaatactggcggcaacttctttcatgcgttttttatgccgaaggcatgaagtttacccttgaataaacttcatgcctggatgcgtgtggatttgttagcgttgcgcaattaatcgcttatatcactcaccttcttattcaataagcgggaagcccgccagtaaatcaacagcatgagtcccatcacaatggtcagcgtaatgctggtagccgcgccaaacggccaatcgcgaatattcaggaactgtaccttaatgacgttaccaatcagcaggtttttcgcgccacccattaaatcggagacgtagaacaggcccattgccggtagcatcacgagcaggcaaccggcgacaatgcccggcatggttaatggaataatgatgcggatgaacgtttgcattttactggcgccgagatcgcgtgcggcctccagtagtggtttgtcgagcttctcaatgctggagtagagcggcatgaccataaatggcagcaaaatgtaaaccaggccgataataacggcgctcggggtgaacatgatgcgaatcggtgtatcaatcacgcccagccacagcaggaattcattgagataacctttagtgctcaggaatattttcagcccatagatgcggatcagtgagttggtccagaaaggaacaatcagcaaaaacagcaataacggacgtatcttttccggtaacttcgccagaaaccaggcaaaaggatagcccagcaccaggcaggagagggtggcgatcagcgccatattcagagagtgcaggagcacttcaaaatagagcggatcgagcaggcgcgcgtagttatccagcgtaaagaccatcttgacgaaactggcgtcgtcacgggtcagaaagctggtgccaatgatcatcaggttgggcagaaaaacaaataacacaagccaaccgacgatagtgacaatcactacattctggaatttacttgtgttcttcatcagccagtacgacctcccagctttctacccaactaatggccattttttggtcaagtgaatggtcgaagtcaggatcgtcttcgttgaagaattcgctgaccatcaccattttgccattttccagttcaaccaccgactccagcgtcatacctttataattgcgctcgcgcacgtagccgataagcccttcgatgtggttatcatcgttgatctcttcgacgcgtagatcttccggtcgcagcaggacgttcagtttttggcctggttcgacagcgaaattgacgtatatattgcactcccgaccttctacgctggcgcggacgcgctgttcatcaagccgttcaatgacggttgcgtcaaagcggttaatttcgccgataaaaccggcgacaaacaggttttttggctcttcatagatttcacgcggcgtgccgtcttgctcaatcacgccattacgcattaccacgatacgatcggacatggtgagcgcttcttcctgatcgtgagtgacaaaaacaaacgtgataccgagtttacgctgtaatgctttaagctcgttctgcatttgtttgcgcaatttatagtccagcgcggaaagcgattcatccagtaataacaggcgaggtttattcaccaccgcgcgagcgatagccacacgctgctgctgtccgccggaaagctggtgcggtttacgttgtgcaaactcttcaagctgcaccatacgcagcgcatcggtcacgcgaggcgctatctcggcggctggcgttttttgcatccgtaagccaaacgcgacattttcaaacaccgtcatatgcggaaataaagcgtagctttgaaatacggtatttacataacgattttcggcgggaacgtgggtgatatcctggttatccaacatgatatgcccggcatcaacggtttccaggccggcaatcaggcgaagaacggttgttttaccgcagccggaagggccaagcagcgtgaggaattcgccattgttaatggtcaaatccagttgcgaaatgacctctttgccatcgaaacttttgctaattcccgacaaaagcaccagcggtgaaagcgaacgcggttgattattcaatttcttactctgtcccatgtaaacgcaacggatggctgaccgctgcggggtttgtggttaaccaccttaatcactcttaatgagggcggtcattctacggcaaaccactgtgatcgccaatccttgttgcgaattactgacttagctttatagtcagaaagcgtgtcaaagtgaaatattcttgtttgcagggataaaagtgacctgacgcaatatttgtcttttcttgcttattaataatgttgtcacgaaaagtgagggtgactgcatggataaactacttgagcgttttttacactacgtatcgctggatacccaatcaaagtcgggtgttcggcaggttcccagcactgaggggcagtggaagttactacgtttgctcaaacagcagctcgaagagatggggctggttaacattacattaagtgaaaaagggacgttgatggcgacgctcccggccaatgttgagggggatattcccgccattggttttatctcccatgtggatacctctccggatttcagcggtaaaaacgttaacccgcagattgtcgagaattatcgcggcggcgatatagcattagggattggcgatgaggtgttgtcacccgtgatgttcccggtactgcatcaattactgggacagacgctgattactaccgatggtaagacattgctgggcgcggacgataaagccggcgttgcggagatcatgaccgcgctggcggtgctgaaaggtaatcctattccccacggcgacattaaagtggcgtttacgcctgacgaagaggtagggaaaggcgcgaagcacttcgatgttgaggcctttggcgcgcagtgggcatatacggtcgacggcggcggcgtgggagaactggagtttgaaaacttcaatgccgcctcggtgaatatcaaaatcgtcggcaataacgtgcatcccggtacggcaaaaggcgtgatggtcaatgcgctgtcgttggcggcgaggattcacgcggaagtgccggcggatgaagcgcctgaaaccaccgaaggttacgaagggttttatcatctggccagcatgaaaggcaccgttgaccgggccgaaatgcactacatcattcgcgatttcgaccgtaagcagtttgaagcgcgtaaacgcaaaatgatggagattgccaaaaaagtcggtaaggggctgcatccggactgctatatcgaactggtgattgaagacagttattacaatatgcgcgaaaaagtagttgaacatccgcatattctcgatatcgcccagcaggccatgcgcgactgtcatattacgccggagatgaaaccgattcgcggcggtacagacggggcgcaactgtcgtttatgggtctgccatgtcctaatctctttaccggcggatataactatcatggtaaacatgagtttgtgacgctggaggggatggaaaaagcggtacaggtgattgtgcgtatcgcggagctgacggctaagcgcgggcagtagcgaatgttacgcattgtggtgaagcgttttattatttatggcgggatattttccgccataaatttttctgcctggagcgccgaatatacgccttcctggtcccagcgccagcaacaatctgcagcatgttttatgactggcgatgaaacctgcatgacgtttattgatgatgcggtgaggctggcctcgcagcaatatggcaaacgctcaatacagcttgttcgtagcctgctattacaaagcgatatttatcaatggctgggtaaaccggagttaacgccgcaaatgctgctgcgagcgcgggcaataatgaaaacatttccggcggacacttatccgggcgatcgggccgatatgtttgaacacctggcggcctttaatgtttacagtgacgatcgttatatagagtattcaccgacagagcagtggcgatacgagatcaaggttgattaccgtcagcagatagcctggcaagagcaggcattaacgtggcgtcttaaagacaaaaaggcatcgacggaagcattggtttataccttaaacaggatgcgcgacgcttattctgatgcgctggaagagcgggatgtcgaatgtgatagtgcgcgtaaagcctattatttggcgaagatagacgcaacggagcggcagtggctgagcgttattttacgagataaaacctgggataatcgtgagcgcgtcgcctcttttttgcagcagaaagcggatattgcttataatgcagggcatattagcgaggcgattaatgcgctaagtcaggcgctaaaaattgagcaaacgctttatggcgccgaattcggcgaaatgacggttgacagcaataatcttgctggcttttatgcacagggccatcattataaggaagcgaaagatctctaccttaaacttatcgcgtattaccagagccgtttaacgccaatggcgacggtaatatcacgattacgcttttatttgcccgaaaacatcgacctggacagtacctccctctatctcccattgctggcagaatataaacgtcggcagtccgacgtatcaatggtgttgtatggtatttcgctgctttatcagagtaatcaagaacttgaacaagcaaaagactttgcggaacgcgcctttacgcttgatgccgtagcttatccagcaaagatgcagtatgaacgattacagcaactggctaatattgccgaaggtcttggagataacgtactggcgcggcgctatcggcaaatgtcatttcgccatcgaatggcccactcgatttatccgggcgatccgcaatataacgatgtcgccaaacctggcggcgatcgttgtggatagtttgcgtcagcccggcggtcgccgggcattgcgatgttcttatccttcgaagaaccagtacccgctattcaccagcgccgccagcatcgcgaggaaggacgggtcttccagcgcatcgccgaagttttcagcggtcagtgcaatatgactggcgagcgcctccagagcggggcgatgcggagagtctattttttcgccattcgcatagacctcatcgccgatacgcaatacgcgaagcccgccgagacgtactaatacctcgccttgctttaaggcatcgtaaatttcatcaggctgatacggcggctccggcggcgcaatatccagttcgtggcgtgactgagagagaaactcgccaagccactgttggaaatgcgcgggttgattgatcaaatcgagcatcatattacgcagtttatccatctcctgcggcaggatatccgccggatgcttgcgggacggcatatccggatcgctgtagtatgtattgcccaactcccgttgcaggacgtaatcggcaaaaccgctgatcagctcacggctattgggcgcgcgaaaaccgaccgaatagttcatggcgttttccagcgcatagccttcatgcgggaatcctggcggaatatacagaatgtcgcccggctccagctcttcatcaataatggcctcgaacggttcgacttgtaacaggtcgggatgtgggcagtgctgacgcatttgcagcttttcgcccacgcgccagcgacggcgaccggttccctggataataaacacatcatactgatccagatgcgggccaacgccgccgccgggaacggaaaaggagatcatcagatcgtcgatacgccagtccggcagagcgcggaacgggcgcatcaacgcggcggtgggttcgtgccagtggtttaccgcctgtaccagcagcgaccagttgctctcacccagatgatcgtagctttcgaaaggaccatggctgacctgccatttgccatcctgatggctaacgagtcggctgtcgatttcgctttccatcgccagccccgccagctcatccggcgagagcggatcgataaagttgctaaacccacgttttaagaccaccgggcgtttttgccagtggcgttcaagaaagtcgggccagttaagagttaattggtattccatgttaagtatccgcaggctggtatctgacaccgattataacggatgcttaacgagatgcgtggaagaacgcacagaaatgtttattcctctttctgtgtgggatgctgtcggccaaaaacgacctccatacgggcgccaccgagcagactgtcgctggcaatgatctgcccggcgtattgttccgtaatctcgcgcgcgacagccagccccacgccttgtcctggtcgtagggtatcggcgcgctgaccgcgatcaaacaccagggaacgtttgctgtggggaatgcctgggccgtcatcttcgacgaaaatatgcaaatgatcgtcggtctggcgagccgaaatctcgacaaactccagacaatatttacaagcgttgtccagtacgttgcccatcacttcgacaaagtcgttttgctcgccgacaaaactgatttctggtgaaatatccatactgatattcacccctttacgctgataaactttatttagcgcagaaatcaggttatctaacaacggcgcgacgggatgcagttcgcggcttaacaacacgccgctaccgcgcatactggcgcgatgcagataatagccgatctgctgggaaatccggctgatctgttccagcatcaccggttcagctttgctgacgctcatcttttcgttgcgtaaagagcgtaacgtactctgcaaaaccgcgagcggcgtttttaaactgtgcgtcaggtcggtcagggtcgtgcggtatttgttataacgttcacgctcgcttttgagcagttgattaaggttgcgcacaaggctggtcagctcacgcgtcgtctccggattgagcatttcgcggtgatgatcttcaagctcgcggacttcccgcgccagcgcctcgatagggcgtaagctccaccaggcggcgatccacagtaaaggaatgactaacagtaaattggcggccagcacgtatacgaaccagctccacaccatataggagcgttttagttctatcggaatggtatcgaccaccacgatggttaactgcggcatccgcgccgtggcaggataaatatttaccgctaccgagtgggtcatctcggcatcatcgtcatcttcacgtacttctttgagtttttcctgcgcggaatggtcttcgctcaacagcgtgctggtggcgtctacgttggtttcaatttcatggaagccgttcgtttttaaccattccggttgaatgcttttaatcagccagggaatgttgcgctgcgtccataataatttgcccgtttcatcgtaaatcagcgtcatggtcgggctttgcatgtccagattttcaggcagctcaacgctgattttattattttcccatttggcgagggtataaaacaggttgctttcgccgcgcagcaaacgaaaggtggttttatcaaaacttacgctatagccgaccagcgccactatgccatatgccaaagaaagcaccagcacgacgccggctgtcgccagcaaaaaacgaacccgcagcgacagcggcagaaaatggcgagcaaatttattcattagcgcaattcaaaaagatatccttgtccgcgtacggtggtaatgacatcgtgcggatactgggcctgtatttttttccgcagacgccccatgagaacatcaatggtatgactttcccgcagttccgcatccggatacagctgaagcatcagcgaatctttgctgaccactttaccgttgttacggataagcgtttccataatggtgtattcgaacgccgtgagtttgatgacctcttcattgacggataattcccggcgtgagagatccacctggaacggcgggatgttgatcacctgggaggccagaccgctattacggcgcattaacgcctgcatacgcgccattacctcttcgatgtggaatggcttcgtcacgtagtcatcggccccggagctgagaacctcgactttatcctgccagccttcgcgcgcggttaacaccagaaccggcagtgaaacatcactgctgcgccagcggcgtattaaggaaaggccgtcttcatccggcagacctaaatcgacaatagcgatatccggaaggtgttcattaaggtagtaatcagcttccctggcatcttctgcggcatcgacctggtgacctgaatcctggagctgaaccttcaggtggtggcgtaataatgcattatcctctacaaccagtacgcgcatcatctcttctcccttgtgttaacaataagaacagtctagcgttgattatggtgctttggggataaacagttaataaaccagacaaatagtcaccctctttctgaagaaaagagggtgaggcaggcattatttaagttcgtcgaccagagtcacagcgcgaccgatataatttgccggcgtcatggctttaaggcgcgttttttctgcttccggcagggccagactatcaataaactgtttcattccttcggcatcaacacgcttgccacgggtcaactctttcagtttttcatatggtttttcaataccatagcggcgcatgacggtctggatcggttcggctaatacttcccagttgtgatccagttcgtcaagcagatgatcgcggtttacttccagcttgctgacgcccttcagggtggactgataagcgataagcgcatagccgatgccgacacccaggttacgcaggacggttgagtcggtcagatcgcgctgccagcgggaaaccggcagtttgtttgccagatggtgcaacactgcgttagacagaccgaggttgccttctgagttttcaaagtcaatggggttaactttatgcggcatggtagaagaaccgatctccccggcgatggttttctgtttgaaatggttcaacgcaatatagccccagacatcgcgatcgaaatcgatcaggatggtgttaaagcgcgcgatacagtcaaacagttccgcaatataatcatgtggttcaatctgggtggtgtaagggttccactggatgcccagcgaggtgacgaactcttcgctgaactgatgccagtcaacttccggataggcggcgatatgcgcgttatagttgcctacggcgccgttgattttaccgaggatctccacctggttgagctggcggaactgacgctccatccgatacgccacgttcgccatctctttacccagagtggaaggtgttgccggctggccgtgggtgcgggagagtagaggaatatcgcgatactgcgtggcgagatctttaaccgcgttaatcacctgacgccagtaaggcaggatcacttcatcgcgcgcggttttgagcattaacgcgtgcgacaggttgttaatgtcctcagaagtgcaggcaaagtggataaattcggaaacgtcatgtagcgccgggatcgcggcgactttttctttcaggaaatactcaactgccttcacatcatggttagtcgtacgctcaatggttttaatgcgcgcggcatcttcttcattgaagtttgccacaagcgtatccaggtaaccgtttgcgtcggcagcaaaagcaggaacttccttgatcgctgcgtgcgcggctaatttctgcagccaacgtacttcgacttgtacacgaaatttcagcaaaccgtattcgctaaaaattccgcgcagcgcgctgactttatcgccgtagcgtccatcgacaggggaaacggcggtcagtgaggataattccatagatcataactccggggttaaatgagcaagaatttgttttgcctgagtcgtcaggcgatgacgagaaaacataagctgtaggcgaccaccgcctacctgatgccagagcacggctgcacggatgcctgccagtagcgaggcgcggactttggcctgcacctgcggactttgcagaacggccggggagcccgtcacctgaatgcgcgggcccaatgggctaatcacatccacgtagatgcccgccatggcgctcattaacgtgtctgactgtaaatcaaaatgatcaagctggcgctgcaggccgttaatgcgatcgcctaacgtattcaatgcgcctttggcggatgacagcttgcgctccagcaccatcaggctaagcgtataacgcgtcagttcggcgttaagtccttgtcggctgctggcattcagcacgccgagcagtgtttccagaccaagacgcaggttggcttcgctgccgccgaacacgcccagagtagaactgggattcatatcaatgacactgttgagtgaaacgtgcaacgcgtcggcatcacagtgtccctggtgcgccagttgttgcaccaggcgtgccgactggcaaatgccagacagcgcgagggtgatgtcataataattctttgccacaatcactgcttccttgtatcaaataaaatacacttcatcttttaagccgctttgaggcgacttgaatggtgttgtgtattgaataatcagaccgtcagcggcagtcgctgctcgataatgccgccgcccaggcagacttcgccgctgtaaaagacagcggactggcccggcgtaacggcggcaaccggctcgtcaaaaatgacctcgatacgatcgtcattcagcgcgttaatcgtgcacggaatatcggtctggcggtagcgggtttttaccgtacagcgcagggtgccggtgaacggttcgcgatcgacccaatgtagctgctgggcgatgaggcctaccgacatcaggcgtgggtgctcatgcccctgggcgacaattaacacattgttttcaacgtctttatccaccacataccaggggtcttcgctaccgtctttggtgccgccgattcccagccctttacgctgaccgagcgtatgatacatcagaccctgatgctcgccgatttcatcgccgtcaacggtaatgattttccccggctgcgcaggcagatagcgccctaaaaagtcgcggaatttgcgctcgccgataaagcagataccggtagaatcttttttctttgcggttaccagccccagatcttcggcgattttacgcacctgcggtttttccagctcgccaaccgggaacagactttgcgcaatctgctcatggccaagcgtatagaggaagtagctctgatctttgttaccgtcgagcccgcgcaacaaccggcttttgccgtttacatccgcgcgacggacgtagtgaccggtggcgatatagtcggcgcctaaatcttctgcggcaaattcaaggaaggctttaaatttgatctctttattgcacagaatatccggattcggcgtacggcccgctttgtactcttcaaggaacagttcaaagacgttatcccaatattctgcggcaaaattaacggtatgcagttcaatgccaagcttgtcgcacacggcctgcgcgtcagccagatcggctgccgcggtacagtattcctcaccatcgtcctcttcccagttcttcatgaacaggccttctacctgataaccctgttgttgcaacagccaggcggaaacggaggaatcgacaccgccggacatgccgacgatcactttttttgggctttctgacattggaatactcgcgacattgaacttcaaggcggcgtattctatcacgcagccctttacttgacaccctctgtaaacggccagttaaattcgcccactatagataaggggtaacgttgtcccgtttgataactgcgaacgctttcagccaccagcggagaacgtaaattcggcgcgttcagaatctcgtcggcgctcacccaacggcagcaatcgatgtcattgtcatgggggtcggtcgcgcaaatatgatcaagcttgatagcgaataaaaagcgcaggaacggggttttatccggcgcaatccactgatgcatacggataaaatactgtggttgcgccgtgatgccagtctcttcccacagttcacgcgcggcggcctgcgccagcgtttcatctgcctccaggtgtccggcaggttgattccataacgatttaccgttgatggtctcttctaccaccagaaatttatcttcggcatgtacgatgcaggcaacggtcacgtgcggcttgaacataggcatccttattaaagcggtttatcaatgtggtcatagatcacgtcaagctgtttcagacgctcgttataagcttttgtcaggcaggtgacgtcggccttgcactgctgacgctgtttaagccagctctgctgggcgtcctgcagggcgccgcgactgcccatcgcgaacaaccctttcagaaactgatatttggtgtgcatttccacgtctttatcattcagcgtcaggtgcgcgcagatagccttttcatccgcagcctgcgctttctggcagtcgaagctggccgcattaacggataacggtgttaataaagcaaaagcaatgagaagccgtttcatctgtctttctcctgtgcgatctcgcgccactgtccattatcgaggccgttgagcgtgtagtcgcccatgctgtaacgaattaatcgtagagtgggatgaccgacatgcgctgtcatgcgtcttacctggcggttgcggccttcatataaggtgacttttagccaactggtgggaatattcttccgttcgcgaatcggcggggtgcgcggccacagccagtcaggctccgcgacaatctcaataccggcgggcagggtagggccatcgttgagcgtgacgccagtacgaagcgcctgcagcgctgcattatccggtataccttctacctgaacatagtaaatcttgccggtgcgtttgcccggttgcgtgaggcgcgcctgcagcgcgccgtcattagtcagcaccaaaagcccttcgctgtcgcggtccaggcggcctgcggcataaacgccttgcacaggaataaaatcttttaacgtgcggcgacctgcttcatccgtgaactgcggcaacacatcgtaaggtttattgaacaaaaccacgcgttttggctggttttctttccgtgatttagatgcttgtcgtgagctgaatcgcttaacgtagtgatttctaaaagaagttttttgcatggtgttttcagaacttattaattgccgcattatagcgcaataatgagtgtctttcatggcggcaaacaatagggtagtattgacatgctcattacaaaacattaacaaaaaattgctctaacgcagtcgtgcagcaggacgccattgcacatgcagcgcgatgacagacgagcaaaccagaagcgctcgaaggagaggtgaatggaaagcaaagtagttgttccggtggaaggtaagaagatcaccctgcaaaacggcaaactcaacgttcctgagaatccgattatcccgtttattgaaggcgatggtatcggtgttgatgtcactccagccatgcttaaagtagtcgatgccgccgtcgagaaagcctataaaggcgagcgtaaaatttcctggatggaaatttacaccggagaaaaatccacacaggtttacggccaggatgtctggcttcccgctgaaacccttgatttaattcgtgactaccgcgtagcgattaaaggtccattgaccacgccggttggcggcggtatccgctctctgaacgttgccctgcgtcaggagcttgacctgtacgtttgtctgcgtcccgttcgttactatcagggcacgccaagtccggtgaaacatccggagctgaccgatatggtcatcttccgtgaaaactctgaagacatctacgccggaattgaatggaaagctgactctgcagacgctgagaaagtgatcaagttcctgcgcgaagagatgggcgtgaagaaaattcgcttcccggagcactgcggtatcggtatcaaaccgtgttctgaagaaggcactaaacgtctggttcgcgcggcgattgaatacgctattaccaacgatcgcgattccgtcacgctggtacataaaggcaatatcatgaagttcaccgaaggcgcgtttaaagactggggctaccagttggcgcgcgacgagttcggcggtgagcttattgacggcggtccgtggctgaaaattaagaacccgaacacgggtaaagagatcgtggttaaagacgttatcgccgatgcgttcctgcaacaaatcctgttgcgtccggcggaatacgacgttatcgcctgtatgaacctgaacggtgactatatttccgatgccctggcggctcaggttggcggtatcggtattgcaccgggtgcgaatatcggcgacgaatgcgcgttgtttgaagcgactcacgggactgcgccgaaatatgcgggccaggataaagtcaacccaggctccattattctgtctgcggagatgatgctgcgccacatgcagtggttcgaagccgcagacctgattgttaaaggtatggaaggcgcgattgccgcgaagaccgtgacctatgactttgaacgcctgatggaaggcgctaagctgctgaaatgtagtgagtttggtgacgcgattatcgcgaatatgtaataacgataattgttaaaaacaaaaacggggacttaacgtccccgtttttattattagtattcgaacggttatcaaaactttatcaaaactccctcaattcagaccgcaatagtagttcatcctttaccccgatcgtcatgataacctgagacccccctgaaagctgatagttaccgattttgattgtagtggttttcttaataatgtgtgatttggctattttttgaaagtgccttaccagatttattgttattatcaggagaattttttaataaaaagtgatggtttattgactacaatagtgggtaggttaagtattttataaaattattagcatgctttatttgctcttctacaaggctgctaagaagtgttgaaatatcagcctgataaagaatacgtcagcgaaagtgaatgctatattagtcataaaaattcaggagacatatgctcaaacctatctgccatagtggaagtataaaggttccggaatatctggaaacagataaggaaaaaaatgccggacgtactccactgtcttcagacattcagcaagttagaaatgttgttgaagatgttccgctatttccagaaagcagaacggcgagaggttctgtaagcgcagcgtacaggctttcttttgacgaagtgttttgcggtctcagcaatgaagagcgtaaaaaggtgtatggtcgcctttttggaaaacaagtacttgcgcatattcattccaggtgtcagcgcgacgctgacataataagagaaaaagcgctcaggcggataagccgtgagtgtggtgccgaaatagattgcgctctcttactaaataagatggtggatattttacaaaatgcccggctgacaataaattttaatgcagcaaaaattgactttgtctctctcttaaaaaataaagaatatctgaactcttatgcattaggttgcagaccgggagatttacctgcttataatgtcgggcgtgattcagttgaaactaaagcatttgaactggagaagcttgcagattcaccttatgccccatatggtcagacaggcggtttttccgtagcatatactcccaacagtagaacttttagcactacaagcagaccaatttatgctgcactggactttctgaacggtgaaaatggaggtgccagcgcctatgggaaatcattttttgaattaaatgataatgtaaaaacaaactgtacattctcaccttttgatatctacggccacagatttggcctggatacgagtaaattatctacattttggcatatggagaacctgattgcatcctgtcaaaatgatttttttggttataattgctttaagagtttggttaaaatggctaaggacgaaaaatttttagctcattctaattatggtaaaggctatgaagggaattatatagaggctcatattcatggtgatgtatgtttattcagagatataaaacacgtttatttgtctttgcaagaaaactcttactcgaaaagtcaactatatgattatgcaaaacaaataaaccaggcgcttaatagagactgcataatattatattgacaagcttattatcagtctctttaaaagagctttaaatgatcatgagcgcatacttcttgaggtaggcagtaactgcttttatatttattatctcaggaccgttctggcagatacctgtgtggcactttagtgtggtctggcaaaatagaggaatatggaccagcagaagcgcctgctggctgcttttcacttaaaatgctggacttcaccggtgcttcagatgaagcgaccttcacagtcatcaagtggcctgtattaccacaggagtgatttactggctatcgatattcctgctcatatcaatgacagtatttcgctctttcccgtacattgctctcccgaccagctcacggtccagtacatgacagtccttttccacttcgctacgcctaattttttttagttgctctgttttattgcgctgaatttgtacctcaaaacaataattttaaatacttatttgaatattttttttatgattttttcaagaaatgagtaaaaaaaatgaagaatgatataaataattaatgcaataaaaaatgatatcacaccaattgatggtcctgttttgtatacgaataacatgcataaaaatatagcaaatagatcaagggaaatatccgcgatgaaatcagtaattattttgaaaaaattcttcatattacctctttaaaatatctattttattcatcatttttaggtcgggcagtgctcgaaattcttacgtacaacgtatacgctccggtttctgcgcgctgcccggcttcacactggctccaacaagtacgcccgctggaatagattcctggcgtcacataacttcacctggttatccacaaaagactcaataaataaacatcttgagtacgaaaaattacagtgtcagagaatgaaatagcgattcgctgtcttcaagcagtgccttagtacctggcacgcgctctttcgcgctataatttttatcaatgtttgtatcgcctgctattttttaaatgtctgctgtatttcgttcatctttccagctgcttttttacgctgactttcaatgtcttttctcgattgttcaacaagttgctgtgctttttcggcttctttttttgggtcgaaaggttctttgatctcatatccggcaatagaaccatccttatttaaggtcattaccgcacgtgctgtatttttagcagtgatggtaatgtcatagacgaattcgccattatgagctatctctgctcgtacaacgatatcgctatcttccgtaacggaaatgatgccactggcgttagcgcgtttaattgtttcctgaatacgctctggtataatgctgaaattgatcgagtcgaatttgaataaagcctcttttagtgcttcttgtttttgctcctctgttatagtgccaaagatggttaaattgacaggcgaaggtcccccccagtagccgttgttaaatttaaacacctctactttagcaggggtgttaacgctttgtcgaatgaatgaatacccgcccttgaagaaacggacttcaataatcgcaagattggctccaccttttgcgttgatattggcaatagctttttgcatttcggctttgtcgtaaaagaacattgattgctggtgctctttttgctggattttttgcatgtatttctcttgatttttttcagcttccgccatggcatctttatcgttatcacaggcgctaattagagttgccgcgatgaaggtaatcggaagtaagagatttttatatgtaacatgtattttattcatgtgaagtatttccctttttatataaaatagatagtcttgactggtcgagactatcctggaaacatagtaataatgcgtgtgcatatctgcagtaagttttagttatgctggttttatttcggatttttacctgttactttttgttcgtaaataggtattttacgtattgatgataagtttagaacctatcccagtaggcgtaatcgttaaagccagtttggcgaataaaagagtctaatgggataggctcttaataaacaacaaaaccaaacgtactttcagatttcaggctggaatgcgcacagctgattgttgataagggctactcataccgacaggccagtgaagcgatgaatgtcggttccacataccggtctgaggtatcaacaacaacatgttctgagtggtagcgtttgcgttatatcgtcacagacagcgcctcagggcgctgttttcgatcggacatgtcgctttcgcaggaggggacgttattcggcgaccagccacatatcagcctcttcaaacatctcttccagcatacggtgcagccgttctttctcggtttttgtacagtcactgtttaatgcgttcgcctgcattggcttaactttcacttgcgcatcgggaaaaagttgatgtacgcgttttgtgagttcattgaggatgatttcgcgtgcgcctggcaaaccttcaacatttcgcttgtcataaacgagttcgacgaacatcgccatttcctttttactggttggatgaccagtatttaagctgggtatataactggtgtcaaggtttagccgccgttttgtcatcctgacgttgcggacgtaaagtaaattgatcgcacgtggaagtaaaggtcgctaacctgttgtcgtgtcaagaggttagcggcactctcttcacagcggtgtcctgctacctgatggtaaattccagggcgcgactaaaatcgcaatcggccaacacaacagggtcgccttttctgacaataatgctatttgtgcccaggcattttcggctctgtttccccttaattttgttatcatcagtgagccagcgctggttatcattacccgtgcatgaataaagaatgattggtgtgccttcttttgtaccttgtcctgcggcatccagacatttctcaccctgcgtgattctgtctcggtgaaatgagaaaagctgagattgcacatgcttacactcccgcagcgtcaaacgattctgttgatctgggcctgcatcaaggcacagaccatcagttgtccgaatttgttccgcgtcatttatgtaataaccaccggaattaatctggttttgtgtaatgaccgggaacgacaaattaatactataaggtgtgggtaagccgttcgtcgtacatccacataaaatagaggagaggcagagaaccagtgtggtttttcctgaaagcaaagtcattcaattattaccctaaaaataaatagcgttacaactatattggcgatttatacccactgaatatgacgtagcattgagcggcaatagagataattccgatagaatcacataaatacttcggttaaatgcgcgcagccagccactcctgtgacaatgggtatatagcgttaaatacttttgcaatattagatgctatcacagtgaaaaacggctgtacatttcttcacgttaaacaaagtgagaagggggggcacccgatatatgataaaagaggtcacaggagtcattagcaaaataaatcttttagattttcgccactgaaaacattctgcagcctttcaggcaaagcctcatagcaggctgcggaggtagacgtactcgctaaatttttctgaaaaaatgccgggtgacgaattatgaaagataaacgttggcggcggtaggtccgcggaggccattaatacgacaaaactcaacgcgtataccggggataagcgcttctgtttcgtgttggcgacatgctgaaatgtggacctgaacatctttgcgtccatcggagggggtgatgagacctttaccgctcttacaatcaaaggttttgacaattcctgtcattttacgagacaaacaaattccttaatggggataacgaggcgcactatacacgtcaggaaaaataatgccagctatatttgatggcaatcaagatttccgggtggctaaaagtagtcgttcggcaccattgtagataaataacattatgttctggagaaagtattccctttcctggcgtcattgactggtgcggacatcatgggttttgtcgtcgggcaggacggtgaactaatctgcctggcttgctttttatcagtatttgtaggtggttgcggggttttactaccaaaatcgtagataaaaatatcccatgatgcctgttgtaaaccagaacaatggcctgaactggccaaaacatggaatgaaaaaataagtaatgaccaaagcataaaagcatgatgtttcatagcacctcctgttatatataatgacttgtgaagttcatctcctgaattatggaacgtcattgacattttttattcaacgaagagttaaccactcttaataataatgggttttatagcgaaatagacttttttatcgcgtgttcaatatttgcgttagttattatttttttggaatgtaaattctctctaaacacaggtgatatttatgttggaattgtggtgttgattctattcttataatataacaagaaatgttgtaactgatagatatattaaaagattaaatcggagcgggaataaagcgtgctaagcatcatcgtgaatatgattacagcgcctgcgatggcatataaccgtattgcggatggagcgtcacgtgaggactgtgaagcacaatgcgatatgttctgattatatggcgagtttgcttaatgacatgtttttagccgaacggtgtcaagtttcttaatgtggttgtgagattttctctttaaatatcaaaatgttgcatgggtgatttgttgttctatagtggctaaacactttatggtttctgttaaatatatatgcgtgagaaaaattagcattcaaatctataaaagttagatgacattgtagaaccggttacctaaatgagcgatagagtgcttcggtagtaaaaatatctttcaggaagtaaacacatcaggagcgatagcggtgaattattcgtggttttgtcgattcggcatagtggcgataactgaatgccggatcggtactgcaggtgtttaaacacaccgtaaataataagtagtattaaggagttgttatgaaaaatattattttatccactttagttattactacaagcgttttggttgtaaatgttgcacaggccgatactaacgccttttccgtggggtatgcacaaagtaaagttcaggatttcaaaaatatccgaggggtaaatgtgaaataccgttatgaggatgactctccggtaagttttatttcctcgctaagttacttatatggagacagacaggcttccgggtctgttgagcctgaaggtattcattaccatgacaagtttgaggtgaagtacggttctttaatggttgggccagcctatcgattgtctgacaatttttcgttatacgcgctggcgggtgtcggcacggtaaaggcgacatttaaagaacattccactcaggatggcgattctttttctaacaaaatttcctcaaggaaaacgggatttgcctggggcgcgggtgtacagatgaatccgctggagaatatcgtcgtcgatgttgggtatgaaggaagcaacatctcctctacaaaaataaacggcttcaacgtcggggttggataccgtttctgaaaagcataagctatgcggaaggttcgccttccgcaccgccagtcaataaaacagggcttctttaccagtgacacgtacctgcctgtcttttctctcttcgtcatactctcttcgtcatagtgacgctgtacataacatctcactagcataagcacagataaaggattgtggtaagcaatcaaggttgctcaggtaggtgataagcaggaaggaaaatctggtgtaaataacgccagatctcacaagattcactctgaaaaattttcctggaattaatcacaatgtcatcaagattttgtgaccgccttcgcatattgtacctgccgctgaacgactactgaaaagtagcaaggtatgtattttatccaggagagcaccttttttgcgcctggcagaagtccccagccgccactagctcagctggatagagcatcaacctcctaagttgatggtgcgaggttcgaggcctcggtggcggtccaatgtggttatcgtataatgttattacctcagtgtcaggctgatgatgtgggttcgactcccactgaccacttcagttttgaataagtattgtctcgcaaccctgttacagaataatttcatttattacgtgacaagatagtcatttataaaaaatgcacaaaaatgttattgtcttttattacttgtgagttgtagatttttcttatgcggtgaatccccctttgcggcggggcgtccagtcaaatagttaatgttcctcgcgaaccatattgactgtggtatggttcaccgggaggcacccggcaccgcaattttttataaaatgaaattcacaccctatggttcagagcggtgtctttttacatcaggtgggcaagcataatgcaggttaacttgaaagatacgatcaatagcagaaaccagtgatttcgtttatggcctggggatttaaccgcgccagagcgtatgcaagaccctggcgcggttggccggtgatcgttcaatagtgcgaatatgaatggttaccagccgctgcgaattctacctgggtcacttaataaagcaaaacatttaaacgctcaacaacgacaattcagacagttcgaacttttctttaaaaataggattaaccatgcttaaaagtggttactaattagccattatactacggtagtgattcacatattctttaacgttacgttacaggaaggttgaagtggaaatgcctgatgagtcttcaggcatttcttaaggttagttagctaaggaacagttactgagaacaggtttatcatcaccttccaccagttcagccgttttgcctttggtataaagtttataagtataatttttgtctatggcttcgtaatttgctccggaggccattttcattaaccgcatcgggatcatctcgtttacctgactgataatcgcataggcgtttccagcctcggtgttgacgtaaatcacctccataacctggttatcattacaggtgtatatagatttagaaatctcctgcgaagctgctatagaggtggtactggcgctaagcgcagcgagaaagagggtaaatgggatcaatttacgtttcatcattagtatcctttgtgcataaaattgtcgttaattccctgaagaacgggagataaagcggcatcaatacgatgaatgctgtagtattcctgtttactgacgaaaagtgcgccagaaaagcgtattataatttatccatcactgacatatgtgatgagtagacaaatcttaaaatcataaactataggctgcaaatcattatggtgcgatagaaaatgattgtcaccactgctcaatactatggcataaaaaccgaagaaaacggtactgttcactgtctcgtttcatacggtatctgtcagtgaaactatttcttcaaatgatggtctttttattatcgatcagataatggcatcaacaggggttattcaggagtatatgtgaaaaagtggcttataggagggatattgatcgcaagttttctgaccggttgtctgatgtggcacaacattgataaatggtttaataaagatatcgaatttttctacgtcggagacgatagctaaaattccagtcagttggcaacgggtgtcatatcttcaggtatggcgcccggagccgccgggcgcaaattgtaggtgtataaaagtcatttcattaaaattttagcgacaacatggacagtcactaccgcgtgctaacggccctctgaagtcacaagatgaataagccagttttttgtttcagcggtgactgaaacatattttgttcctggtggtcttaccgccagttgctgaaaaagacaacgataatgtaactgttgcagagactgacgaatacgacgaccgtgaattttatttttggcgaccatatttcctcccaaaaggccgcccgaaggcggcgctgggtttgataatggagaagggcgttggtcactgccataaccaacctgtatacattaatgcaattgataatcattatcaatttggctggtggagaaaaattgtaaagatgaagggacagcggaaatggcaatgaacgggatgagactttcgttaaccacttaaattcgtgactaaaaaaaggcttttatagacttgaaaatgtttttcccgtccctatgtagtcagtggacaagcaatgcttgccttgatgttgaacttttgaatagtgattcaggaggttaatgatggcactcagaaccttgtcagcacttcccgtgtttgctgattctcttttctctgaccgtttcaaccgtattgatagacttttcagtcaattaacaggagatacgccagtcgctgcgacgccagcttacgatctgcaaaagcgcgatgcgaataactatctgcttaccgtgagcgttcctggctggaaagaggaagagcttgaaattgaaacggttggcggcaacctgaatattacgggtaaacacactgaagagacggtagaggatcagacgcactggatttatcgtggtattcgtaaggcggatttccagttgagtttttctttgcctgaacatgctaaggtgaataatgcgaaactggaacagggcctcttgttggtcgagatttaccaggagatccctgaaagcgagaaaccgaaaaaaattgccatagaaagcaaaccaaaggcgattgaacacaaatcataatcgcgttaatggaggcccgtttagacgggccttcattgtctgtagcgaaaagtatcccgtcatgcttgtaggcacagatcgctaaatattatagccctgacctctatattatcccgtgccactgacctcgtcgccattggacggcggtaagttggaattatccgcgaggtcagtccaatttttgtccactctcgacattctgcctgttatgggcgcgatatctgaacataaattcgtatagcggttcatcgttttcaccgcgttgatgctatttctgctaacactactttcatacgtaaaaaagctgatgctttttaccttatttaatcgaggcaggtatgaaattagcgctcgtcaatcggcaggtcattttaccggaaagcggaaccgagtccttccagtgccatgcctctacgcttgttcgcttaccgtgcggtacgctcgtggccgcatggttcgcggggttgcgcgaaggaagcgaagatacagccatctggctatctcgctatgaacataatatctggacaacaccgcagcgagtggcggcacgcgagggggaagcgcactggaatccggtgttattttacccgtcggataaattgtggttattttataaagtaggcagcgacgtacacgtgtggaaaacctggtttatcacctccagcgatcgaggatttacctggagtacgccagctccgttggttaacgatgatattttgccgcgcggtcccgtaaaaaataaactcctgctggcatcaaatggcgcctggattgcgccagggtcgattgaaagtcctgaacggtggagggcatttgtggatcgatcctctgacgaaggaaaacactggagtatctcttttgtaccgctggagcctgataacgctatttccgggacaaacgtagcgttgtgggatggtataaaaaaggggaggttgtgggaatgttgtctggaaaacctcctgcgctgggatggcgttattcagcctacgctgtgggagtcttctccggggcatatccatatgttgttacgaagcacacgcggggcaatttttcgcagtgattcaatcgactatggcgctacctggtctgttgcccgcgcgacatctttaccgaataataatagtggtatcgatctggttagtatgcaggacggtacgctgattcttgcgttaaatccggtcaacggcaactggggaaagcgctatccgctttcactgattgcttcccaggataatggcgaatcatggctaccgctactggacctggaaagtgaccacggtgagtattcttatcccgctattattagcgagggcggcatcgtacatatcacctacacgtggaaccggaaaaatatcgtatattgtcgattacaaacggtataaggcgctatcagtcgaaaccgatagcgctggaataataatgccttgcccggcgtgctctctcacgccgggatggccgaaatagtcatgatttaccgggtaacatccttgaaaatgtatcgtctttttgtatgtaatggtgaaacaacgccgctgctgcatgcatggcaatcaggaaatagccgatattggccagcatttcatgaatacgctttatatccgattttagggtgctatctggcgtcaaaaataccggtacagtaaaaccaaaaaagctccagcttttcccgcctgacgccatcatcgcgacgcccagcagcggtaaggcgagaaaagtgagataaagcgcgatatgcattaatttagcggctacgtgctgccagtgaggagggggaggcgtaatgaccggatccgggtatttgtgtttaagatataaccgtaaaaacatcagcgcccagaccagaacgcccatatcatagtgcgtgtctttcataaacaggtaaacgctggagccttttggcgcccacccccgtaactcaatagcagcatatgcgatgcctgtcaggagcagtgttaaccagtgaagcgttatttgcagtcttgagaaatgtgccattattattatcctttattaacaactgcttgtagagtatgcgtaaaatcttaacagaaccttaaagcgggggctgagtcgcaaggaacagacagagatagcggcacgtaaaatgggataaaaagccggcggcatcgccggcttactgttgttattgtcctcttacgacaacacaggttttaccataaaacggatatgagcctgtagtttcataatcaacactcgacactaaagaaatatcgcccgcttttttcgctgaatcaatagatgcgtcgccggtatttacaatacccaataccgtttgcgcacacgctttaccggttttggttgccgggagactcgtggcagtaattggccctttaacatccgtatataagccaatccctgtcggtgatggtcctgtagcacaccccgttaaaagagaaccaataaagataattgaaaaaatgtgttttttatttgtcatgggattagtccattataaattaatagaaaacttaccgtccgaaaatgtccggacagtcatttaaaaagtggtgtatattaaatatgcgatattactctttgcaccctcctgttgatgtcgtacctgacggacaaatatccgttgaagccggatatattccccatgccgtgtttttataacttgtgcatcctgtcagcaatgagaacagtacggctaaaaaaatcatcacgagccctggcggcgttaacatttttcggttggactccatagcatgtcatttcatcgggttgccatatgactggcgttctgctggtaagtttcattaacgcccggttcgtttaatattggtttaggtttaaagccaggaggcgctaattacgataccttcttacgtttcagtactgactaataatgttgagaaaatgaacagcgtcgggtgggaagacgcaatacagaatagaagggaaataagagaataagatggcgttaattaacccggtattcctggcgtcatttcccttgcgttttatccccgtcaaaaacggcctttagctcacgttggcgctcccgacgtttgtgcgtatgatgtttttaaaagatcgtcatactttctgttctgcgtcaattttttcattacaaatgctcgccataatgccgtcctcaggaggtctcccgacgtttatgctgcgccgggagaaacaaaaacaacgcataatctgggacaaattgatgattaaaggcaaactggcgctcgtgacgtgcgcgctgactctggtattcacttcgtcgcttttcgccgcgtcggacacggcagacggtcgtaccctgaagctggccattggccctgagccaacggaaggctttgatcctatgctgggctggagccacggcagctacttattgcttcatgcgccgttgcttaagcaaaacgccgacatgagttggggtaatttactgacggaaaaagtggataccagccccgacggtaaaatctggacgctaaccttaaagcccgggctgaaattctccgatggctcgccattaactgccgaagatgtcgtttttacatacaataaagcggcgaagagcggcggtaaaattgacatgggcaattttagccatgcgcgagcgctggacgcacgccgaattgagatgacgctgagccatccgcagagcacctttgtgaatgtactcgggtcgttagggattgttccggccagccgttatgatgaaaaaacgttcgcccgcgaaccgataggcgccggtccgtaccgactggtcagctttcagccgggtcagcaactgatcgttgaagctaatccctggtatgcgggtaaaaagaatgactttaaccggctggtttttgtctttctggatgaagataatgcttatgccgccgcgcgcagcggacagttgggactggtgcgcattgccccttctatggcggtggccccgcagcaggataatcttaaactctgggtacgcgatagcgttgaaaaccggggcattgtcttcccgatggtgccagccggtaaaaaggatgctaacgattatcctgtcggcaacgatgtgaccgctgatgtcgctatcagacgcgcaattaactatgccattaatcgtaagcaactggcggaacaggtgatggaaggccatgcgatacccgcctatagcgcggtgcagggattaccgtggcaaaatccttcagtgatattcagcgatggcgatattgcaaaagcgcgcgccatcctggaagaggctggctggaaaataaacagtgcgggcgtgcgtgaaaaagcaggtaaagaagcgcgtctgaccttatggtatgccagtggcgacagcacccgacgggatctggccgaggcggtgcgcgccatgttgcagcctttaggcattgtcgtctcgttgcaatcgggaagctgggaaactgtagagcgccatatgcacgctaaccctacgctgtttggctggggaagtctggacccgatggaactcttccatcactacagcgggaaagccgctggtgtggaatattataacccgggctattacagcaaccctgcggtagaagcacatctgaaacaggctatagatgcgcctgactggcaaaaggcgattcctttctggcagcaggttgagtgggatggaaagcagggcgcgggcgtccagggcgatgcggcatgggcatggctgcttaatattcagcatacctatctggccaacccctgtattgatctgggaaaaggcgcgccagaaatccacggtagctggtcggtgttaaacaatcttgatgactggacctggacctgtcggtgatgaaattgttcttcagtcattttttgcggctgattattctgttggtgctggtggctgccggcaccttcattttgcttagcttttcgcccgttgatcctatccgtgcttatattggcaacgatctgctccatgttccgccagaacaatatgcgcggattgcggcgcgctgggggcttgaccagccgctgtgggagcgtttcggtcactggttttggcgtctgctccagggcgacatggggtattccatgctgttcaacatgcctgtcgccagtgtgatccgggaacgttttgcgacgtcattcgcgctgctggcaggcgcctggctattgtctggtgtgctgggcgtgacattgggttttctggccggacgttttctccaccgttggccggataagatgatttgccgtatcagctacttattgtcatcgttgcccactttctggatagccatgttgttgctggcgctgtttgccgtccgctggccggtattacctgtttgttgcgcctgggaccccggaaataatgcaggaacagctcttttatcggaacgtttacgccatcttgtgttgccggtatgtgcgttaagtctgttgggcatggggcaaattgcgctgcatacgcgagaaaaaatagccagtgtaatgaagagcgaatttattcgttttgcgcgcgctcagggggataaaggatggtcgctgttacgtcaccaggtgttacgtcatgcgattaccccagcactctgtttacagtttgcttctctgggcgaactgatggggggagcgttactggcagaaaaagtctttgcgtatccggggctgggacaggccactatcgatgccggcctgcgtggcgatgtcccgctactcatggggatcgttttattctgtacactattagtgtttgccggaaatacgatttcagcctggcttgtggtggtgcttaatcgatcgctggagcgtcccgatgctctataatcctgccccgacgttgtttcgtctgctcctctccgttacctgtctgctgtttattgccggatacggttatgccacgttgagccagccgccagaggttaatctgcttgcccggcatctgtcgcctgatatccagcactggtttggcaccgataatctggggcgtgatgtatggcttcgttgctttcagggggccttcaccagtttacaaattggcgttggcgccgcgctgtgcagcggcgttatcgcgttagtgatggcggcagtggcgcgcattcatccccggctggacctcctggtgcggctgataaccgatgctatgctcgccatgccgcatttacttttgctgatccttatctgttttacgctcggcggcggtaaaagcggcgtcattgcggccgtggcgttaacgcactggccccgtctggcgctgattctgcgcgccgacgcggagcgggtagcgcagagtgactacctgacattgacctatcgtctggggcatggacacctttattgctggcgatatcactattttccggcgctattgccgcaatggttgacgggaacgttattgatgtttcctcatgcggtattgcacagcgcggcgttaagttttctggggtttgggctggcgccgcatgagccttcgctggggctgttgctggcggatgcgttacggtttattagccatggaaactggtggctggtgctatttcccggcctaatgttattcacgctggtgatgctcttcgatcagtttgcgcgcgccattcagcggctgtggctaaggagtgacgtatgctgagtttacaacaggttacgctggaaagcgcgcgttatcgctggtatggcgcgagacgctggtcgccgttattacagaatgtctcttttgatatcgcgcccggcgaaatggtggcattggttggcggcagcggggagggcaaaagtctgctgctgcaatgcctgctcgatctgctgccggaaaatttacgctttcggggggagattacgcttgatggcaaccggctggacagacataccatcaggcagcttaggggcaatacgtttagctacgtgccgcagggggtacaggcgcttaatcccatgctgaatatcagaaaacatttgaacagagcatgtcatctgaccggacgcgcctgggatgagacgcaaatggtacagctattacagcaaagcgatcttgaaccgacagtcctggaacgctttccccgccagctctccggtgggatggctaaacgaattctggcgtgccacgcctcgcttagccaggcacgttatatcctcgcggatgagatcaccgcctggcttgataccgcactggcaaaccagttgctcgagcacttgcgaggcctctgcgagcggggatgcggcgtgctgtgggtgactcatgacctgctgctggcggcgcggtatgccgatcgcattgtggcgctgcatcagggttatatcacggacaatatccgctgcgagcagttacagccggaagagatgagtgaaccgttaaaacggcaatggcaagcattgcctgaactaaacccgttatttatgccgaccggagagggaatagaatgctgagctgccgcgacctcgttattcgtcagggcgggaaagtcttatggcagaacctgacgtttacgatttctgccggtgaacgggtaggaattcatgcgccaagcggaacggggaaaacaacgttggggcgcgtcctggccggatggcaaaagccgacggcgggcgacgttctgctggacggcagcccgttacccctgcatcagtattgtccggtacagcttgtcccccagcatcctgaactgacgtttaatccctggcgaagcgccggagacgctgtacgtgatgcctggcagcctgacccggaaacgatgaggcgtttgcatgtgcagcccgagtggctgacgcgtcggccaatgcagctctcaggcggggagttggcgcgtattgcgatactgcgcgcgcttgacccacgaacgcgttttctgattgccgacgaaatgacggcgcaactcgatccgtctattcaaaaagcgatatgggtatacgtgcttgaggtgtgccgcagccgttcattagggatgttggtgattagtcatcagtctgcgctacttgatcaagtctgtacccgccatttacaggtggaatagccgcaagtcgtttctccgcattgccgtgtcgccgttaacgcaccgggaacccatgggttcccggtattgtcggcagagattttactgcatgacgcgtttatctgcgttttttgcatcagcggtattactgtagtccctggtctcttcaacctgtacaggggctctgacaaccagactaggcagcgccagttcgatatcattctcaatgagtttttcaataatacggatatttatctcttgctgaatatccatgtatttattgtaatccgcggtattgacgatatgcaccacctcataggtcagccgatcctgaccaaaggccagtagatgggcgcggtcgaattgtgtttcgccgacatcggtaataatctttttcaccatatcgccgatgaggcgtaacttttccggcggtgtcgcagtggcgacgccaaaagtaaacacgatacgacgcgtttgcatccgcttatagttgtgtatggtttgctgcaacaactgcgcgttcgcacaaacgatctgttcgccgctgaggctacggatgcgagtggttttcaaaccgatatgttcaatcgtaccggctacatcattaaagacgacgaaatcgccgatctcgaagggcttatcgaaaccaatcgatagcgaagcgaagacatcgctcagaacggtttgtaccgccagggcaatagcaataccgcccacgccgaggcttgctaccagtgcggtaatatctacgccgacgttcgccaggatggagagcagcatcatagaccagacgagcacgcgcaaaatcataccaagaatgactaacgtcaccgggtttttattggagcctggggcatacagtaaatgacgcatccatgactgtacgccctgatcaagccaaatcgccatttgaatcgcaaccactaaaaaccaggcgtgagagagggtagagaataaccggtcaggcagggcgacaaagcgcaggctaaagagaaatgcggcaaaaaagattagcatcttactggtctttttcagcatctcgaaaacaataggacgcagccgcccatgagcatcatcctttttatccgggcgttgtagcgctttatagaccacattaagtagccagttgatgagccagtaagtaatgagggtgacgaaaaaaacgaccgccagattgatccagaacgtcgttgacatcagcatcgcaacgatatttagtcgtgctaaatactccattttacctccgatgaaaagcagatgaacattacagtatagacgtcacatcacggaggccgatttccggctttactattgctgttttattcagcacttttgttcaaaaagtatgaaaaagaggggtagccgtttggctatcccggcgtttctgtgcagacttatctactcctcttaataaaataaggagtcatttatgcaacaagaacatcgtgagtgtattgagcagtgttatgaatgcgcggcggcgtgtgatatctgcgcctcttcttgtctgcgtgaagataacgtcgaaatgatgaagcactgcatccagttagatatgcaatgtgcggccatttgtcgcctggcggcgcaatttatggcgttggaaagcgagtactcacaaaaattatgccgcctgtgcgcggatatctgcaaagcctgtgccgaagagtgtgcaaggcacgatcacgaccattgccagaattgcgcgcgggcatgcagccaatgcgcagacgcctgccttaaaatggccgcgtaatttttcttccgccattagctcaaccggatagagcatagagcttctacctctaaggttcggggttcaattcctcgatggcggaccagttgatatcaaaaaaggccacctgcgcggtggccgctgagtttctgttgaaataaatgcaatgttataatataacaatcatctttctaagaaagatgagggtaacgttttggtgattcatttaaaaaaactgacaatgcttctgggaatgctgttggtaaatagtcctgccttcgcgcatggtcatcatgctcatggcgcgccgatgacggaggttgagcaaaaagcggcagcgggcgtgtttgatgacgctaatgtacgcgatcgcgcgctcaccgactgggatggtatgtggcaatccgtctatccttatctggtcagcggcgagctggaccctgtcttcaggcaaaaggcgaagaaagacccggagaaaacgtttgaggatattaaagcgtattatcgcaaaggatacgtgacgaatgttgagacgatcggcattgaaaatggcgttatagaattccatcgcgacaataacgttgcatcctgtaaatacaattatgccggctataaaattctgacttacgcatcgggtaaaaaaggggtgcgctacctgttcgaatgtaaagatgcgaatagcaaagcgcctaaatatgttcagtttagcgatcatatcattgccccgcgcaaatcggcgcacttccatatctttatgggaaatacctcgcagcaggcattgttgcaagagatggaaaactggcctacctattatccttatcagttaaaggcgaatgaggtcgttgacgaaatgctacatcattaagtctgattgcaatgttaaaagctcgctatgaatagcgagctttttttctgccgttatgccatatttctggcaatcaatataaaaaatacctgcgcccccggagcgatgatgacgctgtccataccgccctcgattcaatgccaaacggaagcggcatgtcgcctgattactcgtgtcacaggcgatacgttgcgtgctattcatttatatggttccgctgtcgcgggcggtctgaagccaaacagcgacattgatctgctggtgacaatatgccagccgctgacggaggcccaacgcgcaacgctgatgcaggaattgctggcgctttcatcgccgccgggggcgtcggcagaaaaacgcgctctggaggtcactgtcgtgctttattcgcagctggttccctggtgttttccaccttccagggaaatgcaatttggcgagtggctaagagaggacatttgtcaggggatttatgaaccagcgcagcaggactgggacatggtgttactgataacccaaattctggaaaccagtataccgctaaagggagaacgcgcggaacggctgttcacgccagcccctgcggcgcagttgctgaaggccttgcgttatcccctcgacctttggcaatccacggcagatgtgcagggagatgagtatcatatcgttttaaccctggcgcgtatctggtataccctttctaccgggagatttacctctaaggatgcggcggctgactggctgttacctcagttgccagaagattatgctgccacgttgcgtgcggcgcagcgtgaatatttaggtctggagcaacaggactggcatattttgctgcctgcggtcgtacgctttgtggattttgccaaagcgcacatccccacgcagttcacataagatgccccaggacgtctgtcaggttgcgcaaacggcgttcctcaactactacttaataggttctcatcgctgaagtaagcagatgatcttatgcgggccatcgaatggatattcccacatggctctcgttttgttgaggtggatatgactggttccgcatcatctgttttaaagacagatacaagactattgagcgaaaacctgtttcttaattatggtctggagtccttatttaaggacgtcgcaataatagctggcaacgtaaattatattatttttgatatcgacgattactacaccgtacagcagtatattacttccacatttaaaacggtactcattggaattgttacccataatgaatataactttattgatgaacatcatgtcatatatcgaataaaggtcgatgcctctattgctgagtggcgcgaattactgattttggccgctgctggtcaattttttcccaggtcagagaaagtcagattaacggcgaatgaaagaaatgttttggcgatgcttgttaaaggaatggatatccgacaaataagctgtgagctgaatgtacatttaaaaactatttactcagtacgctaccatgttctgactaaattaggttgtagaacagttctggattatcaaatactgtccgtttctaaagcctttacgcactggcttacaataaataatgttgataatgtaatttcccgtgtaaatagtaaggtcattgcttaataatgatttgcttctgatggcgtttaggttcactatgctttcttacatcatcatgaggccagacaggcatggctacttttagtattagcgcaatggcggcgcagtgtggtgtcacaacagcaaatatcaggtcctgggaacgctatggcctgcttcaacctaccaaagatgaagctggcaatcgtttttattgcatagaagatgctatcagaatacagcatattatcgacgcgttaagcaaaggcttttcattaaaagagattaaacctgccctctatggtgaagaaacgcattgccgctcgggatggttattctaccaggaagagattttagcgcagtgtagaaaattcgaacccgccaaattgcgaaaattactctggcgttatggtcgggaaattccgccgtgtatcgtcattgagtcaatactgcgtcctttacggctgtggttgtccgcaggcgatgatgatgcacgccgatttgaaaaggcattactggatactgcgattattgaatacgccacgttccagctaagtagcgtacgaaaggcgccagcaggcacaatgcttattgctgcgttttcgctgaacgaccccattgagctatggctggaaacgattaaatattgtagtgaaggtatgcgagttgaagtcatcccctggcaggcgccgatgcccgatcttttatcaacgtctttcgagcatattgttctgtggcatgatgagacattaactcccgcgcaggaaaatcttattcaggctttaaaagaatcgggtaaatttagtcttcatgtgaaaaatggctcaggcttaacattactgccagccgtatatcggcagcatgagatgccagaaagcatgcagcatgttgcaccgcaaatccatgcaaacggctacgaaaaatcaggcaccgcacgttgaggcatctgcattattaacgaacaggggaggagtaaacccctcccttgtttatactcttcatacttcaagttgcttatgtgttggctacggattactcggcccatccatgggcctcgccctgacgggccgtcgcacgcgacgttcaaatctgctcccggcagatttgtcgttcaccccagtcatatagttatctatgcttctggggactcactcccttgccgcctttaagcaactcgaattattttgggtatatattagatgtcgtcaggtgtctgaaacaaaacggcttctaaggcattacggtaaatatcaagctgcactacgtctttttctgtttccagtttttcaataagtttggcgatgatatccttatttgagacatgctgctgcgattgcaatagttcgtaagtaatttcctgaatagctcgctgttcacataacatatgtgcagaaaaaggattgccagtactattttgttcgttgactagtgtaatggtagtcatatttcaccatattcgatgtaaattgaagccgatctccctgagcgggggagagaaattagtgacctattaaagttagacctatatcataaaactgtaataaaaaatcataaaaacgtgatgcgcatcacatttgtgtgatttgttgtatattttatacactttaaatgaagattccgcagaatcaacggcctgttcttttttctcactccagtttaaacgaataagcattaatacccatctgtaataattacttaatgttatcttaataaaggtaaattactgtcaggcctccgtaaaaggaggttgattaatgattcgtcatatcgccatttttctttgttctttattgatgtgcagcaccacttttgccgattcggtaacgtcggtatcgcttggcgcgctcttaaccgcgctcaatgaacgcatgttattaatgaaagatgtggctgcttataaaatgaagcaccatctgccgatagaggatttcacacgtgaacaaaatgtttttgccgaggctgaagaagaagcgaaaaataacggtctggacccgcattcgataaccccttttattcgttcgctaatggatgccagtaaagcgatacagtaccgctatttagcgcagtggcgaaccggctcagaaccctcctttccgatacaaaccttgtcggtcacccggcaacgtattcgacaacttgataatcaaatgttgatcattatcagccagcgcttgatggtcggcgctttcagccacgacgatatggtgtggctgagagcgcagtttaatgcgccgaatctgaatgagagcgatatcagtaatgtgttggcagccttatctttggtgcgacgcgcgcgttaactccacatgaggagaggtgggccaatacctggtgattgcctgcggaggtagcgataaaagaacgcttttaggtgatttggatataagcgtggcggaatagcggctggagagacgtggtttcgcttcccatcttccggtgcattcgttagcatactgtttcgcagctaagcgtaaatgttttcaggaagaggttaatgtgttcgcggagtatggtgttctgaattattggacgtacctggttggggcgatttttatcgttctggtaccggggccgaatacgctttttgtgcttaaaaacagcgtgggacgcggggttaaaggaggatatcttgccgcatgcggcgtgtttatcggcgatgcgatattaatgtttctggcgtatgcgggcgtggcgacgctgatcaaaacaacgccggttctgtttaacattgttcgctatctcggcgcgttttatctgctctaccttggcgcaaaaatcctttacgccacgctgacctcaaaagggcgtgcggcgacggaaacggtagttccttttggcgctatttttaagcgtgctttaattcttagcctgacgaatcctaaagccatacttttttatgtttccttttttgtgcaatttattgacgttactgcgccgcatactggggtgtcattttttattttggccaccacccttgaaatcgtcagtttttgctatctgagctttttaattctttctggcgcttttgtaacccactatattggtaccaaaaagaaactggcaaaagtgggcaattctttgattggccttcttttcgtcggatttgccgcccggctggcaacgctccagtcttaaccacctggacccgtcgtcaacggcgggtcattgctctcctttcggttttattgcgtggaaaacagcaaaatagtaaccaataaatggtatttaaaatactgtttttggagcgtaacctttttacgacagcgatgagattatcgctgagtaacctgcgtgaagagggaagcaaatgcggcaaattccacaaaatcatattcatacacgttccacgccattctggaacaaagagacggcgcctgccggaattttcgaacgccaccttgataagggaacgcgacccgacgtttatcctcgtctctcggtgatgcagggggcggtcaaatatctcggatacgctgatgaacattgctctgagccggaagagatcatggtgatcaatgccggcgagtttggcgtgtttcctccggaaaagtggcacaatattgaggtcatgacggatgatacctattttaacatcgacttttttgtcgcgccggaagtactgatggaaggggcgacctcacgaaaagtcattcatgccgggagagaataataatgggaaaagctacttataccgtcacggtcacgaataatagcaacggcgtctctgtggactatgaaacggaagcaccgatgacgttgctggtacctgaagttgcagcagaagttgtgaaggatttggtcaataccgtgcgttcctacgataccgaaaacgaacacgacgtttgcggttggtaaggatcttgtagtatctatttgatataaagtgattttttaaatcagaagccgcatcgcgcgtcgccagcgtgatgcggtttttgcgtattgaaaagcgctgtttatttacatcagacatgggttgaaaagaaacattaagaaaacattaagaatatcgcattgtttgctaatgagagcgtattcataaaacttatgattgggtattaaaaaccagaagagtcttataatcatgaaactcgatacccgattaacttcgtcagcacttactcttgcgcttgccgctgtggtcatcccgtttacggcggactggcaattgcctttgcttaacggcgtggtggtccgatggattgaaaacggacaagcgttatggttactgtttggggcgctatttaccgcctggtatatacggccactttcccgtcccgaaggggcaaagcagttttggctatgggctgttgtctggtgggtggtgctattgggtagaagcaccagttgggggcgtgactatttccctgacgagccgcgtatgctgttcagaacgatttcagtgatattaattgctgcgttagtcttgccagtcctgttttctgccgggctacgtaaggagattgttcgtcgcctacgggacgttcctctgccattgtggctgtttgccgtgacgacatgttcatatctgatttccgacactgtcgagcatcatcggtggttgtcgccgatattcctgcataacgctcgttacacggatttgattgaagagctttatgaagtgccatttatgatcggtttgtttatggtgaccgtggggtttatgcagcaggacaagcaggatgaatgtacggcgctggagatgaccccgtatcacgcaaaatagcgcggctgaaaaaagaccatgaattcgacatgggatagatagcggttagcaaaaaaagcccgcactcggtgaggcgggcaaataatactggaagcaatgtgagcaatgtcgtaccgaacaggtgggttataaactcaaccactcggtattgataaagataatcgttatcattaatgattgcaaccctgatatttatgcgcttttatccacgacgctaaaaggtgatggacatcacaaacttcactttcctgacgatgtgctattctttttaacggcaaataaaccgctaacgttaagacataagtgaggaaaaaatgggcattctttcatggattatttttggacttattgcgggtattttggctaagtggatcatgccaggtaaagatggcggcggattctttatgacgatcattctggggatcgttggtgcggtagtcggaggatggatcagtacgttctttggctttggcaaagtggatggtttcaacttcggcagctttgcagtcgcggtgatcggcgcgattgtcgtgctgttaatctacagaaaaatcaaaagctaaacgcagaactttcagagataataaaggctacgacaggtagcctttattattcaaaatgaatttaccaccagcccagttcggtacccgccaccgcaattagcgcgatgcccatcaacaccatcgttgttttcctcatggttatgctcccggcgcggcgtaaccgccaataaaaaaccatgccaaaaataatattgccgtaatgaaaatgacgacagggaagaggatacccactctcatgctattaccttcactgttcagggggcgccagaatagcagggttttctcagcgacaaaaggttggttgctttgtgacagggcgtggctattgctgacttaacccgggataaacacccactaaagcgctgacagaaagtatggaaatagcgtacccgccaggttatcctggacaaaatatcgctttaaggagtcgttatgaaatttacgtggattgcgttgccaggcgtattgctgctgagcgcttgttcatcgtcgcaacccaacgcccccaggccgccgcgtattgggatgcctaatccggcagccgtctactgtgagcaacagggcggtacgctgatgccggtgcagaccccacaaggcgtgcgttccgattgcaaattgcccaatggcgaaatcattgatgagtggacattatggcgcagagagcaccctgatacgaaaaagtgacaacctgcggtccgacgggatatgattaagaacaatctgataatgagtttcatgcggcgcaagaaaatatgtttcagttaaagccgggcgcgttggcaatagttattggcgctaaaacacccgccggacggcagaatattggtaaatcggttgagctattttgcctgtgccaacccggagatgaattcattaatccagtaaatggacacgtcaccttactgccgaaagaagcgcctcgggcgctgtggctggttacgggcgacgtagcctccgccgatggccagcacggttttgcctgggtgcgggcagaacatttgatgccgttgtccccggacagacaaccaggccaggcggcggcacgacaatcacagctctcgtagccactctgccagcacaatggcatggttctggcgagtatctttagcggcgtatagcaacgttagcggctggtgtcgggcaatatccgccagacgtttgccttcttgatgctgttgcgcaagttctgcccggtattgctgcgcgaagtggttaaaatcaatcagttcgctatgaaaggctttgcgcaattcggtggagggcgtaatggccttattccattcatcatagaccagcgctgcttttttaatgcctcgcggccatagcctgtcaaccaatacccgataaccatcgtctttttccgccgggaaatagacgcgcttacactggattcgcatttttccctcctgtgatggtgtcgcttacggtacttttgtcggatagcggtaatgattttaatggatcaggcctgataaacgaagcgtcatcaggcattcaagtgggtatcaggtttatttatgacgctatctctcgatcgcgtccggcgtagaggccgaaaatcgccatgatgatagccagaaccgtcacgcctgacagcggtagataccagctaccgctggcatcatgaagttttcccatgacgggcggcccacatgccgccagtaaatacccgaccgactgcgccatgccggaaagcgccgccgcctgatgcgccgaactggcgcgcaggccgataaacgtcaggccgaggatcatcgtcgcgcctgaaccgaagccgaacagtagcgtccagatgatcgcctggcccggcacaaaccaaagccccgccgcgcccactgcgcacaatagtgagaccagcgcggcaatccagcgttgatcgttaaagcgatgcaaaataagcggaatagctaacccaggcgccgcggtcgccagttgcagcaggccatgtagcgatcctgcctgtgcttcgctgtaaccgtggctgatgagtattgttggtaaccagccgataatcacataataaatcagtgagttaagtcccagaaacaacgtaacttgccaggctaaaggcgaacgccagataccgcgttcatgtaatgcccgggagctactcaggttagctgagcgggtagtgcgccactgcggcaaccagataagaaacgccaacagcggaaacagcatcagcattaacagcgcgccgcgccagccaaaaccgtgcaacgccagcggaaccaccagcgcggaccccaacgcggcggcggcgcccatcgtcaatgaatacgcgcccgtcagcctggcgacatgttgtgaaaaatcgcgcttaatcaatcctggtagcagcacattacccagcgctatcccgcacccaataatggcagttccggcaaacaacaatgcagcggagggcagggagcggagagcaatacccgcgcaaatcagcagcattgcggcaaacagactgcgttccatcccaaaccggcgggcaataccggccgccagcggcgaaaccagtgcaaacgccagaagcggcaaggttgttagcaggcccgtctgggcggtggaaagaccgtaatccgaacggattgtctccagcaacggcgcagcgccggtaaatgttacgcgcagcgtagtggctatcatcaaaataccggcaatcagtaaagcgccctgtttgccgcgtggtgaaagggctgtcgtcatcgttttctcatctcgtcaggcgaggcgataccttaacagtttttactgtttggatgaatcaagctaaaatgacaatttatcgctaaaatcggacaatataatgattggtctgagactggacggttacgatcccgaccttcaccacgatgccgctgtggccttttgtattcgcgccagggatgatgaactgtttagccctcgccatcagcatcgcaagggacagttgattctcgctctgcacggcgcgattacctgcgaggtggaaaatgcgatgtggatggttccgccccagtatgccgtctggctccccggctcgctgccgcacagtaatcatgtgaccgcaggggcggagctgtgctttttatttattgaacctgcggcggtcgtcatgccggagcgttgctgcacgctgaaaatttcgccgttatgccgggagttgattttgtcgctggcgcgcagaaccgatcccgaaagagcgcaaatgccaacgcagcgccttattcaggtgttgtttgatgaactgccgcagcagccgcaggaacaattgcaattaccggtatcggggcatccgaaaatccgccaaatggttgagacaatggcgcaggagcccgcgcgatggaatacattagggcagtgggccagcgtattcgcgatgagcgagcgtaaccttgcccggctggtcgtcaaagagacgggactaagctttcgtcgctggcgtcatcagttgcaattaatcctggcgctacaagcgctgatcgcgggacgtaatgtacagcagacggcgcaaatgctgggttatgattccaccacggcattcattaccatgtttaaaaaaggcctggggcagacgccaggccagtatctgacgggcgagttactgcttccccacaattaaagagaccagccccgccgcaatcagtgggccgaccggcacgccgcgaaacagcgcgacgccaagtaccgtaccgaccagcagcccggcgacgagctgcggttggtttcccatcagcgtaatgccgcgaccgcccagccaggagacgaaaacgccgacggcaatcgcgaccagcgatttccagttcacaaaagagtggatcaatgtggagggcggtagggttccgctggcgatgggagccattacgccgatggtcagaatgataatcccgacggtgagtccctgtttttcaatccagggaaaaaaggtattcaacggggttacgcggacaataatcagcaccagaattgagacggcgacagtggtgttgtggctgataaatcccagagctgccagtccgagcaggatcagcagagtgacatcaaacattatggtttccttgccaaaaagtaagcctgactactttacgcccaaacggcaaagcgcacaggcctttttaacgattgatgcggatttcaggcaactgcctgaaagacaatctctacgtgaaaaacggcgttgtcattaaattgccatcaacgccgcgtattgctaacaggtgaaccgtcattgttgtcttcctgaggatacaattatgtacgatccaccgtttcttgaagcgctgatgattacggcgtcgtttttcgccatttttatcattatcgttgtgtcggtattgctccttgaagggggaggggactaagccgttggcgatgactgaaagcggcggaagactgccagttctggtcgggcgatgcgcagatagtcctgtgtattcataatgactgatttttccagcaggccggcattaaaggcaatttcatcgaaacgctcaaacaggagcggatcggcgaccagtttcagattggggtgaaaactgaaaggcgggatcgcgccaaaaacgcagccggtcagcatatcgacttccgccgggctggcaagggaagcgcgtaagccgcccagatgtgaagcaagctgagagaggtcggcttgctgatcggccgccagaatagcaagaacgtgctggttgacgccgttgcctttgactttacagaccagcgcttttgcgccctggcccagcgcagtaccacgtatttcagataccgcttcgcatttccctaccgcttcatggttcaccacacgatagcgcgcgttctcctgggttaataaagccactaaacgttggtgtgtagcgacacccttcgcgacttcagtcatttcggccatttctcactcctggtgcaatatgaacatttactgcgaagcactatgatgaacgatgttgtttttgttgtttgttcagatagagctgcgcatcggaagcctggtaggcatcattaatcgtatcattgggctgcatattataaatcccggcagaaaaatggactgtcttatccggtgcgataatttgcaggttacgaataatacgctccggcagatggatagccaaatccgccgcgtaatcaacaagaataatacagaactcatcgccgccgaggcgaatggcgtaatcgcttttacgaatcgatgttttaatcgctttcgccaacagggttataattcggtcgccttcctggtgcccctgggtatcgttgatcagttttaacctatcgcaatcaatagcgacaaatgtcaccggcgtcccggtattgaccaggcgttgcagtcgctgttccagcaccggtgttaatattttacggttgtaaagcccggtcatggcatcgctaatattttcgcgtgtgacgttgcgataaagccgaaagtgcatccgtaccatattaagcaggagcgccgttgccagtaagtaaaaggccagcgctttccaggacgagacaaggaaataggttaaatcaagggacaacgaaacgcgcagcccaccagggatatcatggctataattcacatattgaaacagattatttttgctttgattaataataatttcttttccggagtccatatcctttagtgttacgttaagataacgccaaaccagcggacggtcctgggtataaaaaatattttttaaattatcctggttaacatccaccatcacgatgccttttaacgatcccgccagatagactggcgttaaaaaactcatgacgttttcctgagtaatatcatccatgtagatacttgaaataaccgtacggccggtaaaaagtttatctatatcttttctgttaatacccattgtgcctttttgtaaaaaagtccaacgatgcatggcgaagcgccgtgagttgattaaatcatagaaatagacataatgtttatttaaatcaacgtaataacggaatttaagctccagtgtgcccagcccgtgactatggtcgtcctgcgaacggttgatgcttaccgcctgatcaaatgcaggcagtaaaagggcgtcatcaagattatcggtacactgtgtagcggcggtttgcagagtaccatgtagcgccggataattatgccgggtcaggttgacaccgtgcgtaccgttaatagcttcaaaggcgtcgcaaaacgcgcggtgtttttctgcggtgacggggtctcccggcgcttcaaaagttcgcatcaaatgtgcggcgatgctctgattctggtacttatcgtacaaaaacgacgaatcggctctctccatgatataacgcatataggcattcattgccctgtcgctggcaataagttcgtaaatcaggaaggacgatgtcaaaacgatgacgcttgccgagataaagtgcctgagcgctttatgatgcaaattcatgatgaactacagccctgaaagtcggatgcgttagtttaccatagcgatgagaattcctctaatagactgtttaaaaataaaacgtgttgatgttatggaataaaaatcattctcgatttaataaattcaataatatatggtgttgatattttcagtcgtgactattgtcgcaaaaagtaaattgttaattaacggcatcgatttaacactaacgaaaataaaatagcctttattattacgcgaaaggagtgtgaagtggtaaggataataatgtacttccgttcggaggcactatgaaacgatttaaagaaatggcaacaatttttctttttgcattgctggctgcggggttcacgtcgtctgctatggcagcgtcgggtagtgatagtccgtgggattttgatttttcgggtccatggcttttttgcaaactacaaccccctgattctctgcaattaccgccacctcctggtgagtattgctggcattaataaatccatagtatttcagtgataagtcggcgcatgtaaggttaatccagtcaggagatatacaggtttacggctattatagtggtagtatgtataattgccttgttagtgataaatcagcccgtgactcattacgggctgatttatggttatgcactttgattggcgctctgtttctgaaacaattcgcggaataccggataaatatcctcctgatcgcgaatatgctgcatggcgaagttatcgaacgtcgcctgcagatgttcatactcgcgccataaggtctggtgggcgcggcgggtaatctcgatatagctgtaatagcgcactaccggcagcagctttttcgccagaatctcatgacacagcggtgaatcgtcggcccagttatcaccgtctgacgcttgcgccgcatagatgttccactgaccggggtcgtagcgctctttaaccacttcgtccatgagtttaagcgcgctggagacaatcgtcccgccggtctcttgcgaataaaagaactcatgttcgtccacttccttcgcctgggtatggtggcggatataaaccacttcgacgttcttatacgttcggctcaaaaacagatagagcagaatgtaaaaacgcttggccatatctttggttgcctggtccatcgaacccgagacgtccatcagacagaacatcaccgcctggctggagggctcaggccgtttttcataatttttatagcgtaaatcaaaggtgtcgataaacggcactcgctcgattttagcccgtagttcggcaatctcccgacgtaaccgctcctcttcaagcagttgcgctggttcgctgtggctgatggtctccagttccgtttccagcgcgtgcagttcgcggcgttttcctgccgtcattgctgtacggcgcgccagagagttttgtagcgaacgtaccacgctgatattggccggtacgccgtttgaggtgaaaccggcgcggtgagttttatactcgttaagctggcgatgctggtttttcttcagattaggcagcgctaaatcttcaaagagcagatccagatactcatcttttgaaatctgaaaaacaaactcatcctggccttcgccgtcctggctggcctgaccttgaccgctgccggaaccgccgccgccaccgccttgcggacgctcaatgcgatcattctggataaagtgatcgttacccggatggacgcgatggcgcagaccgccgcgcccctgatgaaacatcggttcgctaatatcatcggttggaatagagacggactctccgctgtcgacatcggtcacagagcgtttattaatcgcttcggaaatcgactgcttaatttgtgctttataacgacgcaaaaagcgctggcgattcaccgtgcttttatttttgccgttaagacgtcggtctatgaaccaggtcatatgccccccgtactgccaactgagcgcctgttctgtcagtgccggatagcgctaacgcttagccagtctacagaacattactttgtaggcccggtaagcgcaagcgccaccgggcattaacatcacgacgatttacgcacgcgcaggtaccactcgcacagcaaacgaacctgtttacgggtataccctttttccatcatccgatcgacaaagtcgtcatgctttttctgctcgtcagtcgacgttttggcgttaaaagaaatgaccggcaacagctcttcagtattggagaacatttttttctcaatcaccgtgcgcagcttctcgtaactggtccagtttggattacggccgctattgttggctctggcgcgcaggacaaagtttactatctcattacggaaatctttcgggttactgatacccgctggtttttcaattttttccagttcggcgttcagcgactcgcgatcgaacagttgaccggtatccgggtcgcgatactcctgatcctgaatccagaaatccgcataagtcacgtaacgatcaaaaatgttctgcccgtactcagagtaagattcgagataggccgtctggatctccttgccgataaattcggcgtatttcgggatcaggtagcctttcaggaactccagataacgctcagcctgctcctgcgggaactgctcgcgctcgatttgttgttccagaacgtagaacagatgtaccgggtttgccgccacttccgcatggtcgaagttgaatacgcgggagaggatcttaaaggcgaatcgggtggagagaccgttcatcccttcatccacgcccgcatagtcgcgatactcctggtacgatttggctttagggtcggtatctttcaggctttcaccgtcataaacgcgcattttcgagtaaatactggaattttccggctctttcaggcgggaaagaatcgagaaacgcgaaagcgtttccaacgtgcccggcgcgcagggcgcatgagccagctcgctatgattaagcagtttctcgtagattttgatctcttcggagattcgcaggcaataaggcaccttcacaatatagacacggtcgaggaacgcttcgttatttttattgttacggaaagtcacccattcagattcgtttgagtgggcaagtatgatgccattaaagggcagggcggaaataccttccgtaccattgtagttaccttcctgggttgcggtcagcaaggggtgcagcaccttaataggcgctttaaacatctcgacgaactccatgatcccctggttagcgcggcacagcgcgccagagtaaccatacgcatccggatcgttctgggcgtgatgttcgagtttacgaatatccaccttgccgaccagcgccgaaatatcctggttgttttcatcgccgggttccgttttggcgatggcaatctgctccagaatggagggccagactttcaccacgcggaatttagtaatatcgccaccaaactcatgcaggcgtttggccgcccacggggacataatcgtaccgagatagcggcgcggaataccgtactctttttccagaatctgcgcgtcttcctgcggattaaacaggcataacggatgatcgttgaccggactacgctcgccgttggcgcttaaaacataaattggcacgcgctgcattagcgatttcagccgttcagcgagcgatgatttgcccccccccacaggtcccagcaaatagagaatttgcttcttctcttccagcccttgcgccgcatgttttagataagagacaatctgttcaatcgcgtcttccatgccgtaaaactcttcaaacgcaggatagcgagcaataacccggttggagaagagtcgggaaagtcggggttcctgggcagtgtcgaccatattaggctcgccgatagccattaatagccgctctgccgcgttggcataagcactgcgatcttgccgacaaatggtaagaaaatcctgcagtgtgaactcttcgtccttggcagcttcgtaacgctggcgatagtgatcgaatatattcatgatatgccatcctttcgttttttcgcacatgttaagagccgttcatatgaatagtagaggctcccggaagaggtagactgaacgccgtctctgctaaggaaaaaaaagcaactctcatgccattttattggtcagaagattaacgtgtccggtgatacaccttcttaacattaagcgtagatggcatttgcaaaacttgcctgtacgcgtcagtggatttcgatgacatatcaataactcatcaggtagaaaaggctggtggatatcagaaaaagcgttcccggtcacataacgatcatcagccgatcatctgaaaataatcggttgtggtgatattaaacggttacattgtgtaaaatagttgggcttacaggtattggcggttacacttttgccgcagaacatttgaataaggaattatggattgtgaccaaacttaaacttctggctcttggcgtgtttattgcaacatccgccagcgtcgcgcacgctgaaagcaacctgacgttgggcgcaggcgttggtgtggttgaacacccttataaagattacgatagcgatgtttatccgataccggtcatcgcttatgaaagcgaaaacttctggttccgtggtctgggcggcgggtactacttgtggaatgacaatgccgataagttgtcaatcatggcatactggtccccgatgtacttcaaaccgggcgacagcgatgaccatcagttgcgtcgtctggacaggcgtaaaagtactatgatggcgggcgtttcttacgcgcatcacacccaatatggattcctgcgtacctcactggcaggggatacgttggataacagtaacggtattgtctgggatctggcctggctgtatcggtataccaatggcgggctgaccttaacgccaggtatcggggttgaatggaatagcgagaaccagaacgattactattacggcgtatcacgtaaagaatcttcgcgtagcggcctgcgcggctataacccgaacgatagctggaacccgtatcttgaacttagcgctaactataatttcgccggtaactggagcgtatatggtactgcgcgctacacccgcctgtcggatgaaattaccgacagcccgatggtggataaatcctggaccggtatcctttctactggcgtgacctatagattctgattgattgaatttgccggaaaaaccacgacaaagcctgcgttatgcgggctttgtgctgtctgaaacgcgaacatgacggcttgcataaatgcgctgttgaccgggtatggcgcagccttatgtgatttatactttgttacatcaatttaaaaaactagccttttatatgaaaaatccaggtgattacaactgcgctaacaattagcgtaataattgttgcaatgctggctgatatcgccctgtcacgtcccgcttatgctatacccattcttcacagcgagtaagacgaatgagcatagtattcaataccgtagccaagcccagcggcagtctgtgtaacttatcctgcaagtactgtttctatcttgataaaccccgggggcagcgcgtcatgtctgacgatgtgctggagacgtatatccgccgggtaattgatgatacgccatcctcagaggtctcgttttgctggcaggggggagagccgacgctatgcggtctttctttttaccaaaaagtggtgcgcttgcagcaacgctatgccaacggcaaaactatctacaacagtctgcaaaccaatggcgtattaatcaatgaagagtgggcggctttctttgcgcagcaccagttcctgattggtatatcgattgatgggccgcaagtcgttcatgataattaccggaaaacgccgtcagggcgggcgtctttttcccgagtcgttaatgctatccgccttctgcaggcaaatgatgtcgagttcaacacgctcactgtcgtgaatgatgcgtcatgctgtcatggcaacgctatttatcattttttgacgcaggaactggaaagtaaacacctgcaatttattcccattgttgagccgctcgcgcaaaaagcgcagcgttctttgacgttatctgacaatgaggattcgccttcgctgatgcccttttccgtcacgcctgaagggtggggcgcctttatgtgcgatgtttttgatcaatggatacgtcacgatgtcggacgcatattcgtacagctttttgataacttacttggcgtctggatgggggagcccgccacgctttgtacgatgcagtcgacctgcggacaaagtttgctggtggagcagaatggcgacgtgtttagctgcgaccattttgtttttcccgcctataaactgggcaatctgcagcaacactctttagaagaaatggcggcctctccttttcagcagcagtttggcgcggctaaagcaaacctttcctcacgctgccagaactgtacgtggcgctttgcctgtcacggcggttgtccgaaacatcgaatttgtatggacggcggcgaacggcaaaattatctctgtaaaggatatctggagttctttcaacatgtgacgccctatatgaatgtgatgcgtcaattattactgaatcagcgacccgccgcgcatattacccgcatcgtcgacatgattgcggatgacgttcgtcagtgacaagaaaatcgcccccttgcgcggtatgatgccggacattaccgtagggtctaagagtcctgtattgttttaccgtcgagtgacattgaaaaggaaatgaaatcagtgaaaaacgtaacgttttgcgggcaggtgacgcttcctgccatcggacagggaacatggtatatgggcgagcgcgcggatcaacgtcagcgcgaggtttcggcgttgcgcgcggggctggatttggggttacgccttattgatacagcggaaatgtatgccgacggcggggcggaaaaggtcgtgggcgaggcgttagcagggcgacgcgatgaggcatttctggtgtcaaaagtgtacccgtggaacgctggcggccagaagatagttgccgcctgtgaagaaagcctgcgtcgtctgaaaacagattatctcgatctctatctattgcactgggccggaagcttttcattcgaagagaccgttgaaggtatggagcggctaatcgcgcaggggaaaattcgccgttggggagtctctaatcttgattatgacgatatgcaggcgctgtggcgcatccctgggggacagcaatgcgcgacaaatcaggtgctctatcatctggcgtcacgtggtattgagtatgatttattgccgtggtgtcaacaacagcgaatgccagtgatggcctatagcccgctggcgcaggctggccggttacgtagcggtttactgaatcatccggtggtgaatgaaattgcgcaagcgcataacgctacggcggcgcaaatcttactgacgtgggtgattgcgcatccgggcgtgatggcgatcccgaaagccggaagtacagaacacgtgaagcaaaatgcggcggcgcttgagatcgccttgtcagcaaacgaacttgccttactggacaacgcctggcctgcgccaaaagggaaaaccgcgttggatatggtgtgacgccggataaaatgtgtaagcgccgccatccggcaggtcatgcctgatggcggctgacgcctttcagatcctatagtaacgccgttatccattcacttttagcgtttagcgacgcagatagtctgcgccagacgagagggtttttcttctgtggcttgttgcggcgcagtagcgtaaaccgtttcaacgcagacaaacgttttatagccgtcatccggcatgtcgcccatgctgacggacaacgccgggccagggttccagcctacgacgttaaggtgatggtggtggaccacatcaatcgtgcggtttaatgtcgcatcgtggatcacgctacatgcttcaggattgaggtaaacgcgatcggtacggtccggaaaggtttgtataccgtcggtcaggacaccttctttagcgtcgttaactttatcaataaaccgatcgccgagtccgctgaccttaacgttggcgatgtcgccaacgttaaaatagctgtggagcgcggatgtggttgcaaattcgccatgcgcttccagttcaatttcacaggttttacccactttaaaacgtgccagcagcgtgaaatcgtgcggccagtatttccgggtggcctcactgctttgcagctcaaatgtcagcattacgccattatcatcttcattatgcgcttttagcgcccacggaagattacgcgcaaagccgtgtgacggcagaccctgttgagccgcaggtccaaaccagggccagcagatcggtacaccgccgcgtagcgccacgccggttttgaaaggcgtattattactgagccacaatacctcttcctcgccaacgggtttccaggagagaaggtgcgcgccctgtaatgcaaaagaggctttaacctgcggatggtcaacgacgatcagatccaggtcatcaagctgacgacgggaaaggacaggggtaagctgttcgataaccgggagggcaaaaattttattaatcattacgcaatcctcttaaccctaaataattcgagttgcatgacaaggcgcttgtgccttgaccagtgcttgcgctggcccgtagaggcgaggccgcaggccgagtaacgcggcaagtgaacgacaaattcatcgggaacgaatttgaacaaccgtaggtaatctccggccagggacatggacatccctgattcatcccgataagttcgacttccgtcagtgattcgggtgagaaagcatagccaacacacctgcaacttgaagtatgacgggtatatctttaagcaaaaaaaagagcgacctgagtcgctcttaccaatgactgtgtcatctcaacttatttggagatgtgagcaatcaggtccagtactttgttggagtaaccggtttcgttatcgtaccaggagaccagtttcacgaagttgtcgttcagcgcgatgcctgctttagcatcgaacacggaagtgcatacttcaccgttgaaatcggtagatacaacgtcgtcttcggtgtaacccagcacgcctttcatttcgccttcggcagcagctttaacagcagctttgatctgctcgtaggtagccgctttttccagacgaacggtcaggtcaacaacggatacgttcggagtaggaacgcggaacgccataccagtcagtttgccattcagttccggcagtactttacctaccgctttagcagcgccagtagaggacgggatgatgttctgagatgcgccgcggccgccgcgccagtctttgtgagacgggccgtcaacggttttctgggttgcggtagtcgcgtgaacagtagtcatcagaccttcgatgatgccgaagttgtcgttgataactttagccagcggcgccaggcagttggtggtgcaggaagcgttggaaacgatgtcctggccttcgtatttgtcaaagttagcgcctttaacaaacattggggtgttgtctttagacggacccgtcagaaccacttttttcgcgccagcggtgatgtgtttacgcgcggtttcgtcagtcaggaagataccggtagcttcagccactacgtcaacaccaacttcgtcccatttcaggttagccggatcgcgttcagcggtaacacggatttttttaccgttaacgatcagatgaccgtctttcacttcaacagtaccgtcgaaacggccgtgagtggagtcatatttcagcatgtatgccatgtactctgcgtctaacaggtcgttgattgcaacgatctcgatgtcagaacgtttctgagcagcacggaaaacaatgcgaccgatacggccaaaaccgttgatacctactttgatagtcatatattccaccagctatttgttagtgaataaaaggttgcctgtaaaattacaaaaaccttacgcagcgtcaagcggaatcgtgtcaatcattgcgacaaatcaatcctctgcacaacctttgcgcggctgattcgcctcactcttcctttcggcttgaaaccacatgggggcgccgccccgaattttaaagggcaaccgagataataatgtgacatcagtcacgattcgtgagccgccatttcgcaatgatcaagtttagaacaaaagttggtactgaggtgttaatgttttgttagaatcggtcaggcaatgtgagcacgtttaaagtgagatgtgagcaaatggctaaccaaccttcagcagaagaactcaagaaaaaattgtccgaaatgcaattctacgtgacgcaggatcgtggcacagaaccgccatttaccggacgcctgctacataataaacgcgatggggtttatcactgcctggtctgtgatacgccgctttttcactcccacaccaaatacgattcaggctgcggctggcctagcttttaccagcctgtcagcgaagaggcgattcgttacatagacgatttttctcatggaatgcagcgtgtcgaaattcgttgcggtaactgcgatgcgcatctcggacacgttttcccggacgggccgcagccaaccggtgagcgctattgcgttaactcggcctcgctggccttttctgacgagaaaaacggcgatcaactgaaaggctgaaaaaacgattcagcaaattattccacaggagcggacacatcatgaatcttgatgagatcattaacagcatgacgccggaagtgtatcaacgtttatccaccgccgttgagctgggtaaatggccggatggcgtggcgttgacgccggaacagaaagaaaacagcctgcaactggtgatgctatggcaggcgcggcacaataccgaagcgcaacatatgacgatcgatactcacggtcagatggtgatgaaaagcaagcagcagctcaaagcggatttcggtattacgtcaaagccgattgcgacattgaaaatgcagtaacggcagccggataagaggtagccgccatccggcggtttcattgccaatgcgttgtgcttaccgggcctgctcattgctgtcaggcacaggcccgccatatttttacccattaacgcttaatgtccagcgagtccgccaactgtttcgctaactgattattgtcatcggtgccttattcccagaacattgcgccagccagcccgcgctttttaatctgttttgttagaagcgctctccagcctgcgttgagctttgcctggtagcgacgctgacgtgacgtatccggcccaaagatctatgcaatggtctcaccgttgcgtgatgtattgaccggatacgatacctgctccgctacctggcgacagcctggccctgcgtctcttcccagtctgccagcgtatacagcgtcgcgcctgccgacgccatctccataaacgcgtgcgcgctatcctgcgggtgaatattcacgccgcgacagccatcggtgataacgttaacggcatagcccaactctagcgcatccagcaccgtaaattttacgcagtaatcggtcgccaaccccatcacgataagctcggtaacgtcatgctcgcgaagccaggtatcaagggtagttttctgccgatgttcgttgtcaaaaaacgcactgtagctatcaatcagcgggttttcacccttatagatgcaggcgtcaatcgcatgttggttaagcaggggatgtaacgccgcgccgtcggtatgttgaacgcagtgatccggccagagcgtttgcggcagcccgtccagctttccctgactatagggttccgcctgatgctggctggcgaagctgccatgctgcgcgggatgccagtcctggctggccagcaccggaatctgccggggctggcaccagtcaataagagcgttggcgatgtcgatggtgctgtcgccttccgctacagccagcgcgccgccggcgcaaaaatcattttgcaagtcgaccagtaataaggcccggtttgtcattatcttctccttgtcgtcgggattttttaatcatccggcgtcaattcaccacgcaagttttgcgccatcgcgctacgaatcgcctgagtgtccagaccctggcttaacaaataatgcagtttggttaaggtggcttcgacggtcatatcggcaccgccaatcacgccagcgtgcgccagcgcattaccggtagcgtacccgcccatattgactcgccctgacatgcattgcgtcaggttaaccaccacgatgccgcgcgaactggcctctttcagctcctgtaaaaacgctttattttgcggcgcgttgcctacgccataagagcgcagaatcagcgcttttaccggctgacgcagaaagttacgtactacctcggcggaaatccccggataaatcgtcactacgcctatcggctgcggcgtaatagggtgaacgattaattcaccagaaccgtagggcgcgggaggcgtatttaaacggcgaatgtgaattcctgcttccagcaagggcggcagattgggagaggcaaaagcgtcaaacccatccgcatgggctttggtcgtgcgattaccgcggaacagacgattattaaaaaacagcgttacttcattaatagggtagttggcggcgacataaagcgcattcagcaaattaatttgcccgtcggagcgcagctcagccagcggaatttgtgaccctgtcacaatgaccggtttacccagattttccagcatgaaagagagcgccgatgcggtaaacgccatcgtgtcggtgccgtgcagaataacaaaaccgtcatactcatcgtagtgcgctttgatatctgcagcgatatgctgccagtcttccggcgtcatatctgatgaatccatcagcggggcatattcatggatggtaaaatccggcatctccgggcggtggaattccggcatcagcgccagctggcgctgaaggtgcccggacaccgggatataccctttatctgagcgctgcataccgatagtaccgccggtataggcaacgtaaattgatttcttttgcatgataatgttcagtcgtgtcgcgaaggacgtattaatgattatcggatggcggctatgagcagacgccgccatccggtatggctattgatgaagcattagcgaacgttcgcgcaagtcaaacagaacgcataacggttttgcggatcgttaaatgccgccagtttatccccctcggccttcaccgtgttggcggcggaaacgagcggcgccgggagcatcgcctgaatggtctccggcagcatggcgcgtactgatccggtcatactgtccatgaccatatcaaggaccgtcggttcgtcctgatagtaatcaagatgccactgtttcagtttcgccagctccgccgctttggcgacggcgtcgtcaaagtcgccgagactgtccaccagaccattggctttcgcgtcttctccggtccagacatggccttgtgcgattttatcaatttgctccggcgtacgcttacgcgcgtctgccaccagcgtgataaagcgtttgtagccgtactcaatactgagttgcatcatctgctgcacttccggtgacagcgctttggtcatcgaaatatccgccagcggcgaggtggaaacgccgtcgctgtgtacgccaatcgacgacaggctgttttctaccgtattgatgacgccgaagatgccaattgaacccgtcagcgtgctggggctggccacgatatagtttgccggcgtagagatccagtaaccgccggaggccgccataccgcccattgagaccaccaccggtttgccagccgctcttgccgccgccagttcggcgcggataacttcggaggcgttgacgctaccgcctgggctattgacgcgcagcacaatcgctttcactttaggatcaaggcgtgcgtcgcggatctgcgatgccgtagtgtcgccgccgacattccctggcgtttcttcgccatccataatcgcgccattggcgaaaataaccgcaatagtaccgccggtatccgcaggcgttttcagcgaataatcgtaatagctgatcgcgcgatagttattttcggttttgctccagccaaactgcttcgtcagcgctttttcaacatctgcgctggaggcgagggcgtccaccagtttatggtcgagcgcatatttggcggtgtcgccgcccacgctggttaacccgtcgataatagcctgcgcgccggggaagagttgttgcggcgaaatctggcgattggcggaaacggtatgcaggtagttctgccacagttcgcctatccagcggctgtcggcctcgcgggcggcgggcgacatatcgtcgcggataaacggctcgacggcggatttataggtgccgacccggaaaacgtgggtagagactttcagtttatccagcagcgttttgtagtacaggccattcgtagcgaagccgtgaagatctacctgaccctgtggggaaagccaaattttattagcgaaactggcgagataatactgaccctggctgtagttttcacccacggcgaaaaccggtttgccgctgtcgcggaattcgcgcagcgctttaccgatatagcgcattgatggctgatcggcgccggtgaagtttttcagatccagaacgatacccgtgatattacggtcatctttcgcctgacgaatagcgttgacgatgtcaaacagggagttttcctgcagacggtcggagctggcgccaaataactggcgacccagcgcgcccagacgatgattggtggagggtttatccacaatgacgccggaaatatccagcagcagagcgccgcgcgcggtttgctcactgttgctgccgttaccgatctgcatccagatcccaacgcccaccaggaccagaaaaataaagaacaggttgagtaccatttcacggacgaagttcaacactcgccacgtccatttaaaaaatccggcaataaatcgccacagggttcgcatgtattctccctatctgagtaacaacgcttgtaccttggtgaggataaagcattaagatgtggctatcgtaatgacccatcaggcagttgtcagcaggaatcactgcctgcgctgtaacaaaatccgctcccgtgttaattttgtgaataaatatcattgctggagttaatcaaatggatgcactagaactgctggtcaaccgtcgtagcgcctctcgtctcgcagaaccggcgcctgtcggagagcaattacagaacattctgcgggcgggaatgcgtgttcccgatcataaatctctacagccgtggcgtttttttgtgattgaaggagaggggcgcgaccgcttcagcgccgtacttgaacaaggcgctgtcgctgccgggggggatgagaaggcgatcgaaaaagcgcgtaatgcgccgtttcgcgcaccgctgattattaccgtggtggcgaaatgcgaagaaaaccataaggttccggtgtgggaacaggagatgtctgccggatgcgcggtgatggcgatgcaaatggcggcgattgcgcaagggtttaatggtatctggcgtagcggcgcattaacggagagcgctattgtgcgggaagcctttgagtgccgcccgcaggataaaattgttggttttctctatctcggcacgccgcagctcaaagcgtcaacgacgatcagtacccccgaccccacgccgtttgtgcgttatttctgacgctgagggataaaactgtctggattctgagcaaaggcgcggtaattcagacagtgatacttaccacatcagggaatgagcgctaccatagcgcgaatgcaatgacaggagatgtccatgagcgagcaagccattcgtttaacgcaatacagccacggcgctggttgcggttgtaaaatttcccctaaagtgctggagactatcctgcatagcgagcaggcgaagttcgtcgacccgaacctgctggtgggtaatgaaacccgcgatgatgcggcggtttacgatctgggtaatggcaccagtattatcagcaccaccgacttctttatgccgatagtcgacaacccgtttgattttggccgcattgcggcaacaaacgccatcagcgatatttttgcgatgggcggcaaaccgattatggcgatcgcgatccttggctggccgattaataccctgtcgcccgatattgcgcgtgaagtgaccgagggggggcgttttgcctgccgtcaggccggtatcgcgctggcgggcggacactctattgacgccccggagccgatctttggtctcgcggtcacaggcgtagtgccgaccgaacgggtgaagaaaaacagtaccgcgcaggcgggatgcaaactctttctgaccaaaccgttggggattggcgtgttgaccaccgccgagaaaaaatcgctgcttaaacctgaacatcaggggctggcgacggaagtcatgtgtcggatgaacgttgctggcgcggcgtttgccaatatcgacggcgtaaaagctatgactgacgttaccggttttggcctgctggggcacctgagcgagatgtgccagggcgcaggcgtgcaggcgctgctttgctatcaggacatccctaaactgccgggcgtggaagagtatattgctctgggcgccgtaccgggcggcacagagcgcaacttcgccagctatggtcatctgatgggcgacatgtcgcgtgaagttcgtagcctgctgtgcgatccgcaaacgtcaggcggtctgctgttggcggtaacgccggacgccgaagacgatgttaaagccaccgcggcggaatttggtatcgatctgaccgcgattggcgaactggtcgaggcccgcggcggtcgcgctatggttgagattcgttaacctgatgcggttgtttattgccgaaaaaccgagtctggggcgcgccattgcggatgtgctgccaaaaccgcaccgtaaaggcgatggttttattgagtgcggaaacgggcaggtcgtcacctggtgtattggtcatttgctggaacaggcgcagccggatgcgtatgacagccgttatgcgcgctggaatctggctgacctgcctatcgtgccggaaaaatggcagcttcagcctcgtccttccgtcaccaaacagctcaatgtgattaagcgctttttgcatcaagccggtgaaattattcacgccggcgacccggatcgcgaagggcagcttctggttgatgaagtgctggattatctccagcttcctgccgaaaagcgccagcaggtgcggcgttgtctgataaacgaccttaacccgcaggcggtcgagcgtgctattgacaggctgcgggcgaacagcgacttcgtgccgctgtgcgtatccgcgctggcgcgagcgcgagcggactggctgtatggcattaatatgacccgcgcttacacgatcctgggccggaatgccggctatcagggcgtgttatccgtgggacgcgtgcagacgccggtactggggctggtggtgcggcgagacgaagagattgagaacttcgtcgccaaagacttctttgaagtgaaggcgcacatcgttacgcctgccgacgagcgttttaccgctatctggcagccgagcgaggcgtgcgaaccttatcaggatgaagaggggcgcttgcttcatcgtccgctggcggagcatgtagtgaaccgaatcaacggtcagcccgcgctggtaaccagttataatgataaacgggaatcagaatccgcgccgctgccgttttcgctctcgacgctacagattgaagccgccaaacgctttggcctgagcgcgcaaaacgtgcttgatatttgtcagaagctatatgaaacccacaaactgattacctatccgcgttccgactgccgttatctgccggaagaacactttgccggacggcaggcggtcatgaacgcgattagcgtccacgccccggatttactgccgcagcctgtggttaatcctgatacgcgcaatcgctgctgggatgacaaaaaagtggatgcgcaccacgcgattatcccgacggcgcgcagttcttctgtccatttgacggaaaacgaagcgaaagtgtacaccctgattgcgcgtcagtatctgatgcagttctgcccggacgcggtgtttcgtaaatgcgttattgaactggaaatcgccaaagggaaatttgtcgccaaagcgcgttttctggcggaagccggttggcggacgttactgggcagtaaagagcgcgacgaggaaaacgacggtacgccgctgccggttgtcgccaaaggtgatgagttgctgtgtgaaaagggggaagtggtcgaacgccaaacccagccgccgcgtcatttcactgatgcgacattgctttccgcgatgaccggaattgcccgcttcgtgcaggataaagatctgaaaaagatcctgcgcgcgaccgatgggctggggacggaagccacgcgcgccgggattatcgagctgctgttcaaacgtagctttctgaccaaaaaaggtcgctacattcattctaccgatgctggcaaagcgttaatacattcgctgccggagatggcggcccgtccagatatgaccgcgcactgggaatctgttttgacgcaaatcagcgaaaagcagtgccgttaccaggatttcatgcaaccgctggtcggcacgttatatcagctgatcgagcaggctaagcgcacgccggtgaagcgcttcagagggatagtcgcgccaggcggtggagacaagaaaaagagcgcgccgcgtaagcgagcgggcaaaaaaagcccgcctgctgcggagacaggccgtcagaccgaataagcgtaaagctatctggcctgacgacgggattaaatgacgccctgcgccagcatggcgtcggcgactttcacgaaaccggcgatgttggcgccctgaacgtagttggtatgcttattgtcgccgccgtattcgacacaggcgtggtggatatccagcataatgtgatgcagacgggcgtccactttctcggctttccagctcaaccgcgcggcgttctgcgccatttccagccccgatgtcgccacgccgcccgcgttggcggctttacccggcgcaaacagtacgcccgcttcaaggaagagatcggtcgcttcaatcgtggttggcatatttgccccttccgccacggcttttacgccattggcaatcagtacgcgcgcggcgtcaacgtccagttcgttctgcgtcgcgcatggcagggcgatatccaccggtacgctccagggctgctggccttccagataggttaagccaaactcacgggcgtagtcagcgacgcgaccgtcacggctggctttaatttcacacagacgcgccagcttctctggcgtgaagccactttcatcgaccaccgtcccgctcgaatccgacgcggtaaccacgcgcgcgccaaaggccatcgctttctcaatggcgtattgcgctacgttgccggagccggacacggcgacgcgcatcccttcgaaaccgagaccatgacgtttaagcatcgcttcggtaaagtagaccaggccatagcccgtcgcctccgggcgaatcaggctgccgccgaaggaaagccctttgccggtgaagacgcaggagctgttattggaaagcttgcgcatcattcccgccataaagcccacttcgcgcccgcccacgccgatatccccggcaggcacgtcggtatccggccctaaatggcgatacagttcagtcatcagcgcctggcagaaacgcatcacttcgccttcgcttttccctttcggatcgaaatcgctgccgcctttaccgccgcccatcggcaacgtggtgagggcatttttaaaggtttgctcaaagccgaggaacttaaggatggaaaggtttaccgaaggatggaagcgcataccgcctttataggggccgatagcagagttgaactgcacgcgccaggcgcgatttacctgcacctggtttttgtcgtccagccacactacgcgaaactggattacgcgctctggttcaaccaaacgttccagtaaagacatgtggcggtaacgggggttttgttcaagaaacggccacagggtggtcatgacttcacggacggcttgcgcgaactcggtttgatgcgggtcgcgcttttgtacatggttgaggaacgattccagagaacatgtctgatccatagatataaaaacctcttatatattaatgtggttgtatttgcgttttatcagaatatgtatttgcagttttcgactataccatcagcaatgtgacggtaagcaagaaaaaaatgacgctgctaagtaaattcataacggggcgagggtcataactaaaagcgatgacaaaagaggattaaagttttcacggcggcttaccgttatactgagaatatacttagaaaaataaggaaatcctatgcgccgaagcctcgtggtcgccgtgatggcgataatgccaatggtcgggctggcaaaccagaacagtcgtcctgatattcaggtgaatgtcccgccggaagttttcagcacgcgcggtcagtcgtcccagccctgcattcagtgctgcgtttaccaggatcagaattactccgaaggcgcggtaataaaagtggaaggcgtcttgctccagtgccagcgtgacgaaaaaaccatcagcacgaatccgttagtctggcgtcgcgtaaagctataaacgcctgcaatagcggaatatccgccggggcgagggggtactccagcgcctcttccggcgtacaccaggctaatgcctgatgttccagcgcacgtatcagaccgttaaacgcaggcacatgccaggcgtgcaaatgaattcgtcggccagacacgtcgcgttgatggctggcgatatagacgccgggcgtggcgtcaatccctaactcttcgcgtagctcgcggataagcgcctgcggctgggtttcgccgggttcgactttaccgccggcaaactcccataaaccggcttgatccgcatgagctgggcgctgggccagcagaattttgccgtcgcattcaatgatggcggcaacaacatcgagtttttttatcattgtcgttaaggtcgttattcctgccgggaagcgtcgcgctatcccggccttacggttaatcagaaagcggaatcaaacacgaaacgtcgcccagaccggcgcatggtcggagggtttttccatactgcgaatgtcgtagtctataccggtttctgcgcaacgttccgccagcggagcgcttgccagcaagaggtcgatacgcagcccgcgattatccacgaaacctttcgagcggtaatcaaaccacgaaaatttatccatcgtttgcggattcgcctgacggaacgtgtccactaatccccacttcagtaaccgtgacatccattcacgctcctccggcaggaaggagcatttaccggtacgcagccagcgtttgcggttttcttcgccgatgccaatatccagatcggtcgggctgatattcatgtcgcccataattaataccggattatcgcacttgagttccgtttcaagatagttttgcaagttctgataaaactgcgctttcgcggggaacttcaacggatgatcccggctttccccctgcgggaaatagccgttaatgacggtgatattacccagcggcgaggggatttccgccatgataatgcggcgttgcgcctcttcgccatcatccgggaaaccgcgtctgacggaaatgggcgtggcttttgttagcagcgcgacgccgtaatggcccttttgtccatgatagaaaacgttatagcccagcttcgcgacctcttcgagcgggaacatttcgtcgtggacttttgtctcctgtagaccgatcacatcgggctggtgtttttcgacaatcgcttcaagctgatggggacgggcgcgcaggccgttgatattaaaagagacaaatttcatagtcactgccactttgcaaggtgaatcgtgttgggatggtaacagaaattttaccgggtgactgccactcatcgtcagattcggccaatggaagcgtatggtgttttctatagcgcgaaaatggcacggtttgcgtgcagatgcgccagaacggggcggtaatttccagtaaatttcgtataagatcacaattccagaattatatttggcaactgaataatatttcgctttttcctctttttagccaccgattatgcggaaatattcacttttcatgcagtaaaagtgaatatcgctacgctgtaacccattgatttaccgtttatcacctctgtttatgcaatgttaacgctggctggcacgaatgctgcaatctacatttacagcgcaaacactcatattaattaacatataaataactttatttttaccaaaagaggtcgctatgtctctgtcagttacgcgcgaaaactttgatgaatggatggtgccggtatacgttcccgcgccttttattcctgtacgcggagaaggctcacgcctgtgggatcagcaggggaaagagtatattgattttgctggtgggatcgcggtcaacgccttgggacatgcgcatccggcgctgcgcgaggcgttaaatgaacaggcgaatcgcttctggcatatcgggaacggttacaccaatgaaccggcgctgcgactggcgaaaaaactgatcgacgcgaccttcgccgaacgcgttttcttttgtaattcaggcgctgaagcaaatgaagctgcattaaaactggcgcgcaaatatgcccacgatcgtgtcggcaaccataaaagcggcattgtggcctttaaaaacgcgttccatggccgcacgctctttaccgtcagcgctggcggtcaacccacctattcacaggactttgcgccgctgccgccggatattcgtcatgcagcctataacgatctgaactccgccagcgcgctcattgatgacaatacctgcgccgtgatcgtagaaccggtgcagggcgagggcggcgtgatccccgccacgaaagcttttttgcaggggctgcgtgaattgtgcgaccggcatcaggcgttactgatttttgatgaggtgcagacgggcgtcggacgtaccggcgaactgtatgcatatatgcattatggcgttacgcccgatatcctgacgaccgctaaagcgttgggcggcggcttcccgatcggcgcgatgctgaccacgcaagactatgccagcgtcatgacgccaggcacgcatggcaccacctacggcggtaatccgctggcgacggcagttgccggaaaagtactggatatcatcaatacgccggagatgcaaaacggcgtcagacagcgccacgatgcgtttattgaacgtctaaatacccttaatgtgcgttttggcatgttcagtgaaattcgcgggctggggctactgcttggctgtgtgctacagacggagtttgccggaaaagccaaactcatcgcccaggaagcggcaaaagcaggcgtgatggtgctcattgccggtggcgacgtggtgcgttttgcgccagcgttaaatgtgagcgacgaggagatagccaccgggcttgatcgttttgccctggcgtgcgaacgccttcagacgggaggcgtaccatgcgggtgattcgtcctgtcgaacatgcggatatcgccgcgctgatgcagcttgcaggcaaaacgggcggcggcttaacctcgctaccggcaaatgaagcgacgctggcggcccgcattgaacgcgcgctaaaaacctggtccggcgagctgccaaaaggcgaacaagggtatgtattcgttctcgaggacagtgaaacgggtgaggtcggcgggatctgcgccattgaggtcgcggtcggccttaatgacccctggtataactatcgtgtcggtacgctggttcatgcctccaaagagctgaatgtatataacgcgttgccaacattattcctgagtaatgatcacactggcagcagtgagctttgcacgctgtttctcgatcccgaatggcgtaaagagggtaacggctacctgttgtcaaaatcgcgctttatgtttatggccgcgtttcgcgataaattcaatgagaaagtggtggcggaaatgcgcggcgtcattgacgagcacggttattctcccttctggcaaagtctcggcaaacgctttttttctatggatttcagccgggcggattttttatgcggtaccgggcaaaaagcgtttatcgccgagctgatgcccaaacatcctatttatacccacttcttatctgaagaggcacaggccgtgattggcgaagtccacccgcaaacggcgccagcccgcgcggtgctggaaaaggaaggctttcgctatcgccactatatcgacatcttcgacggtgggccgacgctggagtgtgatattgaccgggtgcgggctattcgtaaaagccgactggttgaagtcgcggaagggcaacccgcgcctggcgactatccggcatgtctggtcgccaatgaaaactatcaccactttcgggccgcgctggtgcgtgccgatccgcagacttcacgacttgtacttaccgcagcgcagttggatgcactgaaatgtcgcgcgggcgaccacgttcggctggtacgcctttgtgctgaggagaaaaccgtatgacgctatggataaacggcgactggataaccggtcagggcgaacgccgccgcaaaacgaacccggtgagcgcggagatactttggcaggggaatgacgctaatgcggcacaggtcgccgaggcctgtcaggcggcgcgcgcggcgtttcctcgctgggccagacagccttttgccgcacgacaggctatcgtagagaaatttgccgccctgctggaggcacataaagccgagctcacggaggtcatcgcacgtgaaaccggtaaaccgcgctgggaggcggcgacggaagtgacggcgatgatcaataagattgccatctcgattaaggcttaccacgccagaacaggcgcacaaaaaagcgaacttgtcgatggcgccgcgacgttgcgccatcgtcctcacggtgtgctggcggtattcggcccttataactttcccggccatttaccgaatggccatattgtgcccgcgttgctggcaggcaatacgctgatcttcaaacctagcgagctaacgccatggaccggggaaacggtaataaaactctgggaacgggcggggctaccggcaggcgttcttaatctggtgcagggcggccgggagaccggacaagcgctgagttcgctcgacgatctcgacggactgctgtttaccggcagcgccagtaccggatatcagcttcatcgccagctatccggccagccggaaaaaatcctggcccttgaaatgggcggaaacaacccgctcattattgaggatgcggcaaatatagatgcggcggtacatctgacgctgcaatcggcgtttattaccgccggacagcgctgtacctgcgcgcgacgccttctggtaaaacagggtgcgcagggagatgcatttctggcgcggctggttgacgtcgccggacgtctgcagcccggcagatgggacgacgatccgcagccgtttatcggcggactgatttcagcgcaggcggcacagcatgtgatggaggcctggcgtcaacgagaggcattaggcggtcgcacgctactggcgccgcggaaggtcaaagagggaacctctctgctgacgcctggcatcattgagctgacgggcgtcgcggatgtgccggatgaagaggtgtttggtccgctgctgaacgtctggcgttatgcgcatttcgatgaggcgattcgtctggcgaataatacccgttttggtctgtcgtgtgggctggtgtcgacggatcgcgcgcagttcgaacagctcttgctggaggcgcgggcagggatcgttaactggaataaaccgctcaccggggcagcgagtactgcgccgtttggtggtgtcggcgcgtctggtaaccatcggcccagcgcctggtatgccgccgattattgcgcctggccgatggccagtctggaatctcccgaactaacgttgcctgcgacattaagccccggcctcgacttttctcgcagggaggcggtatgacggcgcatgaagttaattttgacgggctggtggggcttacgcaccattatgccgggctatccttcggcaatgaggcatcgacccgccaccgttttcaggtgtcgaatcctcgtctggcggtaaaacaggggctgctaaagatgaaagctctggcggatgccggctttccccaggcggtgatcccgccgcatgagcgaccttttattccggcgttgcgtcagctcggcttcacgggtagcgatgagcagattctggataaggttgcgcgtcaggcgccacgctggctttccagcgtgagttccgcgtcgccaatgtgggttgcgaatgcggcgacggtttgcccatcggcagacgcgctggacgggaaagttcacctgacggtggcgaatttaaacaataaatttcatcgcgctcttgaggcgcctgttaccgaagcgctgctacgcgccatatttcgcgatgaaagccagttttcagtgcatagcgcgttaccgcaggtcgcattattgggagatgaaggcgcggcgaatcataaccgtcttggcggcgagtatggttcggcaggcgtgcagctttttgtctatgggcgcgaagaggagaatgaaatacgacccgctcgttatccggcgcgccagagccgcgaagccagcgaggccgtggcgcgtcttaatcaggtgaatccgcaacaggttatcttcgctcagcagaacccggaggtcatcgatcaaggcgtattccataatgatgtcatcgccgtttcgaatcgacaggtattgttttgtcacgaagcggcgtttgcccggcagaaagtgctcattaatcagttgcgtacgcgcgttgacggttttatggcgatagaggtgcccgccggcgaggtttctgtatcagatgctgtggcgacctacctgtttaatagtcagttgctaagccgtaacgacggcttaatgctgttagtgttgccgcgggaatgtcaggaccatgtcggcgtctggcgctatctgaataagctggtggcggaggataaccccatcagcgcgatgcaggtgtttgatttgcgagaaagtatggccaacggcggcggcccggcctgtctgcgattacgcgtggtgttaacagaagaagaacgaagggcggtgaatccagcggtaatgatgaatgacgctctgtttacggcccttaacgcgtgggcggatcgttattatcgcgatcgcctgaccgctgccgatctggccgatccgttattattgcgagaaggccgggaggcgctggatgtgttaacgcgtctgctggatttggggtcggtttatcctttccagcaaacgggggcggctgatggataactttctggcgttgacgctaagcggcacgacaccgcgggtgacgcaggggaagggcgcgggttttcgctggcgctggttaggccatggtctgcttgaactcacgcccgatgcgccggtcgaccgcgcgttaattctttctgcggggatacacggtaatgaaaccgcgccggtcgagatgctggataagctgctgtcggcgctgtattcaggcagcttgacgttaacgtggcgagtgctggtggtactcggcaatccgcaggcgctggcggcgggaatacgctattgtcacagcgatatgaaccgtatgtttggcgggcgttggcagtcctttgccgaaagcgatgaaacgcggcgggcgcgtgagctggagctaagtctggagaccttcttttcatctggccaggcgcgggtacgctggcatctggatctgcataccgccattcgtggctcgcatcatttgcgttttggcgtattgccgcagcgcgaccgcccgtgggagacagattttctggcgtggctgggcgcggcaggactagaggcgttggtatttcatcaggcgcccggcggtacgtttacgcactttagctctgaacatttcggcgcgctttcctgtacgctggagttgggaaaggcgttgccgtttaggcaaaacgatctgacgcagttcaacgtaacctcgcaggcgttgtcggcgttgctgagcggtgtcgaaacgtcaacctcgttttcgccgccgctacgctatcgggtggtgtcgcaaatcacgcgtcacagcgacaagttcgcgctttatatggatgcgcaaacgctgaattttactgcctttgcgaagggaacgttgctggccgaggagggggataagcgcgtgacggtgacgcatgacgttgaatatgttctctttcctaatccctctgtcgcctgcggattgcgggctggattaatgctggaaagactgccctgataaatgtccctgtaagctcacgttaggattacagggatgatttgggacacagtttcatgctattacggattattcctggagaattgctttattaataagcgttgctgcgttatagttctgcataatttctgctatatcatgctgttgtatatttctctttcaactctgcgcaatttattctttttttcttcacaattggcgaaaaagtgttttttatactttcattgttttaccgttgttatgactaattgacgctaagacggttaaagttaatcacgacaacacggcgctgttttaaatatgccgtaaaaataactgaaaggaaggatagaaatatgcgtaaactgactgctctatttgttgcctctaccctggcgatgggtgctgcgaatctcgctcatgccgctgagactaccaccgccgcgccagcggatgcgaagccaatgatgcagcataaaggtaaatttggcccacatcacgatatgatgtttaaaaacctgaacctgacggacgcacagaagcaacaaattcgcgacattatgaaagcgcagcgcgagcaaatgaaacgtccgctgctggaagagcgtcgcgccatgcatgatattatcgccagcgataccttcgataaagccaaagccgaagcgcaaattacgaaaatggaagcgcagcgcaaggccaatatgctggcgcatatggaaacccagaataaaatttataacgttctgacgccggagcagaaaaagcaatataacgctaattttgagaagcgtctgacggaacgcccggcgcaagaaggtaaaatgcctgctgcggcagaataactttccgcataatttaagaccgccggtcttgtcgacaacacaatcgttgaggtggacaggatcggcggttttctttatgactggcgacagtcggtgtgcagttcaatgatctcatattgacctgacattaacggtttacagagaatcttatagccgtcctgatcaaaacccgcaggtgtgcgcaccagggtggcggcctcatccagcgagggtaccgcccccagccataaccaattgttgataatgtggaactgggtcatttgtgggcggctctcttttaacgcgatagcgcctttccagggccagcaaaccacacgtaaccgttccagcgaggcctgcagacgaagaaaatgcgcctgcggggtttcttgcccacaacacgcgccagcgcagcgcttcagagcgaaacgaaaacaggcgcgcccacggcttaccggttcaagccccagcaggccataacacaatttttgttcatcggcgaggttctgtaagctttgcagcgccgcccgacggttggcgaagaggccaaacaggtttggctcatgggaaaaatcgacgctgcgggcggaaacgacctcaatcttttgttcgctcaactggagagagcaaagctggcgattacgccgtaaccgcttgttaaacagcggctgttgttctttgatcagccgcgcctccagcagcaacgcgcccatttccccagcggtgcagatccagcttatccgccgcgcctgtcgcagcatagtggcctcgtcaggcgttcgcagatgtgaaagcacccggctgcgaatattcacgcttttaccgatataaagcggcagcgtatcgctttcgctatgaaatatatagacgcccggtaaggctggcgcttcgctgaggaaaggacgtaaatgttctggatattcgtaaatggccgccgcttcaaactcaaggcggggggctgattgacgccgtaccacagtgatctccgttaactggttattcatccagtataacagcggatgggtgattaaaaaagaggctgggaagagaggaggccggatagacgagcgatatccggcacaacagtagaagtacgcttaccttttccaaaagtcgtcgaataccgtaatcggtaaacggcgcttatgttcagtttttacataccagccttcgatagttttagcgatggcggggtccagcgttttgccttccaggtaatcgtcaatattgtcatacgttacgcccagcgcggcttcatcaggcagtgaagggcggtcgtcttccaaatcggcggtggggacttttttatacagatgctcaggacagcccagcgctgcgagaagctgtttgccctggcgtttgttaaggcgatgaagcgggttaatatcggtaccgccgtcgccatatttggtgaagaacccggttatcgcttccgccgcatggtcggtgcccaccacgacgccgtgagtcataccggcgatgctatattgcgctttcattcgctcacgcgctttttcattgccgcgaacaaaatcgctcagctcaattcccgcttcgcgcagcgcctgttcgctggcgaggacggcgcctttaatattgacggtgagtactctgtccggctgaataaaagcaatggcgtcctggcaatcctgttcatcagcctgtacgccataaggcagacgaacggcgataaactgcagcgcattatcaccggtctcttctcgcaattcggcgatagccatctggctgagtttcccggccagcgtcgaatcctgcccgccgctgatgcctaacaccagcgatttcaaaaagggataggttttcaggtacgctttaagaaaatccacgctgcggcgaatttcttcttcagggttgatatgcggtttcgcgccaagcgcctggattatctcttgctgcagagtcatttaacccccttcgacattaaaaaaatgaatctttaccctgttaaagctaacccttcgccgctgaaacaacaaggtttggcgggctaagcggtgtttaaaacaacatgtcgctgcgttagagaattttccgaaagactttttgtggcgaggcgcggcttgaaaaatgttctgatgtattccaggcttacataacacgctgataaacaagaggacggaaaatgaacaagaacgtagcaggaattttaagcgcagcggcggtaatgactatgctggcaggttgtacggcgtatgatcgtacaaaagaccaatttgttgagcctgtcgttaaagatgttaaaaaaggaatgagcagggcgcaagttgcgcagattgcgggcaaaccgtcatctgaagtgagtatgattcatgcgcgcggtacctgtcagacctacatcctgggtcaacgtgatggtaaagcggaaacctactttgttgcgctggatgataccgggcacgtgattaactccggctaccagacctgtgcggagtacgacactgacccacaggcgccgaagcagtaacaactgtacattgcctgaacattcaaggaaaccggcctgcgagccggtttttttgtgcctgccataaccttatttattatcgcgaattatttgcccgaaatgtgaggggggtcataacgccaggtcaatgagagacaatttagtgggtcaaggaaataccatccggtggtccgatcccgtatactcatttcagccacctaaaaaagtaaatccggttacgcaagtcgcccagagtatggatgcaggttgaggcttgcggcgtatctggttgacagataatcgcacatgaggaaggtttttatggaaaagaaacacatttatctgttttgttctgcgggcatgtcaacatcgttactggtatcaaaaatgcgcgctcaggctgaaaaatatgaagtgccggtgattattgaagcattccctgaaaccctggccggtgaaaaaggcccggcagcggacgtcgtgttattaggcccgcaaattgcttatatgctccccgaaattcagcgtttattacctggtaaaccggtagaagtcattgattcaatgttgtacggcaaggtagatggcttaggcgtgcttaaagctgcggtagcggcaattaaaaaagccgccgcgaattaattattttttaatttttcccgtcaaagagttatttcatacactaaccgcaatattttattgcggtatttaagggtatttttctatgagtaacgttattgcttcacttgaaaaggtactccttccttttgctgtaaaaataggaaagcagccacacgttaatgcaatcaagaacggctttattcgtttaatgccattaacccttgcgggggcgatgtttgtattaattaataacgttttcctgagctttggggaggggtcgtttttttattccatgggcattcggcttgatgcctcaaccattgaaacacttaatggattgaaaggcatcggcgggaacgtctataacggcacattgggcattatgtcgctcatggcgccattttttatcggcatggcgctggcggaagagcgcaaggttgatgcgctggccgccggattgctttccgtggcggcatttatgaccgtaacgccgtatagtgtcggcgaggcctatgccgtaggcgctaactggctgggtggtgcaaatattatctccggtattattattggcctggtggtcgcggagatgtttacatttattgtccggcgcaactgggtgattaagctaccggacagcgtaccggcttcggtgtctcgttcattctcagcattaattcccggctttattattctctctattatggggattatttcctgggcgctgtctaattacggttctaacttccatcagattattatggacactatctctacgccgctggcatcgctgggtagcgtggtagggtgggcatatgtcatttttgtaccgctgctgtggttctttggtattcatggttcgctggcgctgaccgcgctggacagcggcatcatgacgccctgggcgctggaaaacatctctatttaccagcagtatggctccgtcgatgcggcgctggaagccggtaaaacgttccatatctgggcgaaaccgatgctggattcttatatcttcctcggtggtagcggcgcaacgctgggtctgatcatcgctatcttcctggcatcccgtcgcgcggactatcgccaggtggcaaaactggcgctgccgtcaggtatcttccagattaacgaacccatcctgtttggcctgccgattattatgaacccggtgatgtttatccccttcattctggttcagccgattctggcggcgattacgctggtggcttactatttgggtattattccgccgattaccaatattgcgccgtggaccatgccaaccgggttgggggcgttctttaacaccaacggcagtgtcgccgcgttgctggttgcgctatttaacctggcggtcgctaccctgatttatctccccttcgtggtggtggctaacaaagcgcagaacgccatcgagcaggaagaaagcgaagaagatatcgctaacgcactgaaattctaaactccgcgccggcatgggatgccatgccgggctgaatcagaggaaagactatgtttgatcttgaaaatgttgtagataaccagaccgcggctgaggaactcgaagaagtcgttatggggcttatcatcaattctggtcaggcgcgcagcctggcatatggcgcgctcagaaaagcgaaagaaggcgattttgaggcggcgaaagcgatgatggaccagtcgcgcatagcgctcaatgaagcgcatcttgtgcagacaaaactcatcgaaggcgatcagggcgaaggcaaaatgaaagtcagtctggtcctggttcacgctcaggatcatttgatgacatcaatgctggctcgtgaactgatcgccgagttgattgagctccatgagaaactgaaataacagggggcggatgatgcagctacaggttaacgcaacggaaatcaaaacggtttatgagcagcagctcttcaatggcaaaaatttccatgtgtttatctataacaagacggaaagcgtcaccgggctgcatcagcacgactactatgaatttaccctggtattaaccggacgttattaccaggagattaacgggaagcgtgtgctgctggaacgtggagattttgtttttatcccggtggggtcgaatcaccaaagtttctatgagtttggcgcaacgcgtattctgaacgtaggaattagtaaacgtttttttgaacagcattatcttccgttactgccgttttgttttgtggcatcgcaggtatacagggcgaatagcactttccttacctatattgaaacggtgattgcgtcgttgaattttcgcggcaatgggctcgacgaatttatcgaagtggtgacattttatattataaaccgcttacgtcattaccgcgaagagcaggtttatgatgatattccacaatggctgaaagcaaccgtggagataatgcatgataaaacgcagtttggcgaacatgcgctggaaaatatggtgcgcctgtcggcaaaatcccaggagtatctgacgcgcgccacccgacgttattacagcaaaacgccgatgcaaatcattaatgagattcgcattaattttgccaagaaacagttggaaatgaccaactattcggttacggatattgcttatgaagccgggtatagcagtccaagtctgtttattaaaacgtttaagaagatgacctcatttacgccgaatagttatcggaagcgattgacggaaattaatgagtaacggtttgcattgctcgattaattacatttcacgcttgccccaatagcgcggggaacgtcacgctatttcttacgagcgggcatagcgtaatacatatcagtgttatacactgaagggagatattatgagccagaaattaaaagtcgtcactattggtggcgggagcagctacacccctgaattacttgaaggctttattaagcgctaccatgaattacctgtcaccgaattatggctggttgacgttgaagacgggaaagagaagctgggcattatttatgatctctgccagcgaatgattgataaagcaggcgttccgctaaaattgtataaaacgctggatcgccgggaagcgctgaaaggcgctaattttgtcactacccagctacgcgttggtcaactcaaagcccgtgagctggacgagcgtatcccgcttagccacggctatctggggcaagaaaccaacggcgctggcggtttatttaaagggttgcgtaccattccggttatttttgacatcattaaggatgttgaagaattatgtccgaatgcgtgggtcattaactttactaacccggcggggatggtgacggaagcggtttatcgtcataccaactttaaaaaattcatcggcgtatgtaatattcctgtcggcatgaaaatgtttattcatgacgtgctggcgctgaatgagaatgacgatctttccattgacctgtttggtctaaaccatatggtctttattaaagatgtgctggtgaatggcacctcacggttcgcagaattactggatggcgtggcgtccggtcagttgaaagcgtcaaccgtaaaaaatatctttgatctgccgtttagtgaaggattgattcgctcgctgaacatgctgccgtgctcttatttgttgtattacttcaagcaaaaagagatgttggcgattgaaatgggcgaatattacaaaggcggcgcgcgcgctcaggtcgtacagaaagtggagaaacaactcttcgacttgtacaaaaatcctgagctaaacgtgaagccgaaagagcttgagcaacgcggcggcgcttattattccgatgccgcttgtgaagtcattaacgctatttataatgacaagcagactgagcattacgttaatattccacatcatgggcatgtcgagaatatcccggcggactgggcggtggaaatgacctgcattctgggacgcaatggcgcgacgccgcacccgcgtatcacccgttttgacgaaaaagtgctggggcttatccacactattaaaggatttgaggtcgcggccagcaatgcggcgctgagcggaaactttaatgatgttctgctggcgcttaacctgagtccgctggtgcattccgaccgcgacgcagaagtcctggcgcgtgaactcattctggcgcatgaaaaatggctgcctaattttgccgcttgcatcgaagcgcttaaaggtaagcaccactgacagaggtaggctatggaacgcgtgttgattgtgaatgccgatgattttggcctgagtaaagggcaaaattacggcattgttgaagcatatcgcaacggcgttgtgacctccacgacggcgctggtcaatggcgaggctattgaccatgcggcgcagcttagccgcgagctgcctgcgcttggggtgggaatgcattttgttttgacgttaggcaaaccggtgtcagagatgccgggcctgacgcgagacggcctgttggggaaatggatctggcaaatggcggaggaggatacgcttccgctggatgaaattgcgcatgaactggcgtgtcagtatcagcgtttcatcgacgtatttggcagcgagccaacgcatctcgacagtcaccatcatgtgcatatgttcccgcaaattttccccatcgtcgcccgctttgcggcgcagcgcgggattgcgttacgtattgaccgccagacggtgttgaacgccgacgatctgccgtcggatttgcgcagcactcaaggatttagtagtgaattttacggcgaggagatcaccgaagcgtgctttttacgcattctggatgcctcggcgcatcgaggagaggcctcgctggaggtgatgtgtcatccggcgtttgtggacaacattattcgccagagcgcctattgttacccccgcttaactgaactggaggtgttgacgtctgcgtcactcaaggcagcgattgcggaacgtggatatcgtcctggcagttttcttgatatttagctcctgagtttgcggcgcaagaatgcgccgcattttttgctgtttatgcaggaatcgcgttaattttccccgcacgcgaccagacacggtgtgccgccatcagcgtcagcagagtgtccataaagtggtggtcaacgttatctgcctcaacaagtccttcttccccctggctatcaatgtttaaaagcgccttaaaccgtcgggcgtcgcctgccagtgcgatgggcttcagatgtttgtaggcttccagaaggtagtaacgggcatcgccgcaactctcgatatcggcaatattgccgcacggtactattaccgcatcgaccgttagcgacggcgcgccggcaaaggttgccgcaatcgttaatgttgaaccatcatcagccgttacttcacccatccgtgaatagagcagttttgcgtggacgcctttggcttttaaagcctgcaaaatggtcaacagttcggcggcgttaactttgtcgttcagcagaatagcgaccactcggcctttaacatcgccgtccggcaccgcatacaggctgagcgccggatcttttttcagaccgttgacatcaggaggcggggcaatttgcgtttgctcatgggtgagtgcaaaaccgagattatgcgcgacgccctgagccagcgtgacatcaatatgcgctaactgatcgaccacccgctcccgaatatacgcgcgggcgactttacccagttcaaagctgaacgcgtcaataatatgctgctgttctatcggcgtctgactgagccagaacaggcgaggatgcgagtaatattcaccgaaagaggggctgcgttcgcggattttattgccatccacgcgttcctggtatgattcgaagccgccgcgttttggcgctggcggcgtttcgcgtggccagttgtcattaatggagtttggttcatagttcgccggattggtgtcgatatccatccggtgcataccgtcacgctggaagttatggtaggggcaggtagggcggttaatcggaatttcgtggaagtttggcccgcccagacgactgatttgcgtgtcggtataagagaacagacgcccctgtaacagcggatcgttggtaaaatcaatgccgggaacaatatgtcctggatgaaatgccgcctgttcgttttcagcgaaaaagttatccggattacggtttaacaccattttgccgacgcgttgtactggcaccaactcttccggaatcagtttggtcggatcgagcagatcaaaatcgaatttaaattcatcctcttcggcaatgagttgtaggcccagctcgtattccgggaaatcgcccgcttcgatggcctcccacagatcccggcggtgaaaatccggatcgcgaccggtcagtttttgtgactcatcccataccagcgaggctttacctgccaacggtttccagtggaaacggacaaaggtcgctttcccttgtgcattgatcagacggaaggtgtgaatgccgaacccttccatcgtccgataactgcgtggaataccgcgatccgacattgcccacatgacgttgtgcagcgtctcaggctgtaaggaaacatagtcccagaaggtgtcgtgcgcactctgcccttgcggaatagcccaatgtggttcgggcttaacggcgtgcacaaaatccggaaacttatgcgcatcctggataaaaaagatcggcgtgttattaccgacgagatcgaaaattccctcttcggtataaaatttggtcgcaaaaccgcggatatcacgtacggtatcagcagaccccgcgccgccctgtactgtcgaaaagcgaacaaagaccggggtaattttctgtggatcgcacagaaacgcggctttcgtgatgtcgctcaggtctttatatggctggaaatagccgtgcgctgcagatccgcgggcgtgaacgatcctctccgggatgcgctcatggtcaaagtgggtaattttctcgcgcaggataaaatcttccaacagcgtagggccgcggctgccggcgcgaagagaattttgatcgtcggcgatgcgcacgccctgattggtggtcagcgcataattttcgctgcctttacgaaaggcgtcgagggcagtgagcttatcattcgcggtctcgggcgcttttaagctgccgggggccgtcggttgcgcgcccggcggcgtcgtttctggcgtggggcgatgtgaaccgtctgacggcgccagggagtccaggccgggctgtgattcacgggtatcatgcacgggggactgatggggggatttctcattatgcgacattgaactcgtctcctgctttcatcactgaaatgggcgtggtagtagtcaaaatcactctaactatagaacatttcagcaattatgctgggggagagcggaacggcagacagggtataacagggaaatcgcacgcgcggaacaggacgtcgggggcgaagatcggctaaaatagtgtttttctgatttttagccttagagcctatcccagtaggcgttattggcgcagccagtttggacacggacagcgcgcaaaaaccggagcgtacacgtagtacgtgaggattttgagcactgcccaggaccaaaatggcaagtaaaatagccctaatgggataggctcttagcctcttttagtgaagcattaatgatgaaacctcttcgccagcaaaatcgccagattattagctatattccgcgtgttgaacccgcgccgccggaacatgcgataaaaatggatacgtttcgcgacgtctggatactgcgcggtaaatatgttgcctttgttctgacgagggagtcatttcaacggtcgcccgcctttagcgtgccagaatcggcgcaacgttgggcgaatcaggttcgccaggaaaacgaaatcgctgactaagaaaaaacaaaacgccggtactggagaccggcgtttttagtgacagacattttgagttgccgatcgtcatgtctcagacgatgtgaacgcccgataatgtattatcgatgcgccagttcagcgtcttcttcgctatcgagaatggttttatcggtctgcttcagccactggctggtcagcgtaccagcggtcattgagccactcacgttcagcgcggtacggcccatatcaatcaacggttcgacggagattaacagcgcgaccagcgtgaccggtaagcccatggcaggcagcacaatcagcgcggcgaaggtcgcgccgccgccaacgccggcaacacccgccgaacttacagtaacgatacccaccagcgtggctatccatacggggtctaaggggttgatgccgaccgtcggcgcaaccattaccgccaacatcgcaggataaagaccggcacaaccgttttggccgatggtcgcgccaaaagaggcagcaaagctggcgatggactccggcacgcccaggcggcgggtttgcgcttcgacattaagtggaatggaggcggcgctggagcggctggtaaaggcaaatgtcagcaccggccacaccttgcggaaatatttcagcgggctaatcccgttcacgcccaatagtatgccgtgaaccacaaacattatcgccagaccaagatatgacgctaccacgaagcttccaagcttaataatgtcctgcagattggagccggcaaccactttcgtcatcagcgccagtacgccgtaaggcgtaagttgcatcaccagacgcaccagcttcatcacccagctttgcagggtatcgatagcaacaagcacacgctcgccttttggcgcatcatctttcagcagtttaagcgcggccacgcccaggaatgcggcgaaaatcaccacgctgataatagacgtaggatttgcgccagtcagatccgcaaacggatttttcggtacaaaagacagcaccagttgcggcacgctgagatcggccactttgccgacatagctcgtctcaatggcattcagacgcgcggtttccgcgccgccctgaaccagaccttccgccgtcagtccgaacagattggtgaccagcacgcccaccagcgctgcgataagggtagtaaacagcagcgtgccgatagtcagaaaactgattttccccaattgagaggcgttatgcagtcgtgccacggcgcttaaaatagaggcgaataccagcggcatcacaatcatttgtagcaattgcacatagccgttgccgacaatattgaaccactgaatggagtcttttaacacctgactgtcagcgccataaatggtgtgcagggccagaccaaagaccacgcccatcacaaggccgacaagcacttttttagccagactccactgtttatgacgggcctgcgccagtacaaacagcagaatgacgaacaccgcaatgttcgcaattaatggaaaattcatccccgttctcctgatttttttattatgaagcgctgtgttttagcgattctgttcgcgcaagattagcagaactgtgagctggctcttatattcaaatggaatggtttataccaaaaatgattttggcgttgatttactaatcaatctggtgatttataaaacgattgaactgcatttgcaggatagtaatcatctgcgaagaccagcgtatgacgttgttttccggcatggactgtggcatccacaccgcccaggcaaacaacgccatgcataaaaatcgctccagttgattgcctttgcgcggcgccagaataggcaggcggaaacgccagcggcacggccacagtaagggaacgcctgcgggggtgagcatatccgcgacgatatggcttaaatagccaagtaccatgccttgcagcgcatccgccgggataatccacgtatccggtaccttgagataaaaggtcgccagtagggcaaagaccgccagcagactatgggtaaacccccggtgaccgaacgcgcgggcgatcggtttcgatacccatttcaggcgctgaccaagaaaagatttggggtggtcgatatccggcagcagacaggtcaaaatagccgaaggaataatatgccaccagtcgccgtgcgcaaggacgggcgttaactcggcattcttggcgaaaaccgcgctggctatagaaaaaagaagatgtccttccgccgtcatgataaaacccattaaactgtcaattcatacagtatagggtttttatacagtaggcggaagtggtgacgttgtaactctttgtctctgtcaaagccgcttgccgtctggctcagcggctaattgcccgttgactttgtttcggaaacatcttaaccgagtagatgcgccgccgtcagctctgtcagtgagttaagtttgacattcgccagcgcaaagcgcggatcaggctggttttcttctgctggcaccacaatggcgcgcattcgcgccgcctttgccgcgattaaaccattcaccgaatcctccagcgccacgcaggttaatggatcaacgcctaatttggccgcacaatccagatagacctgcgggtgcggtttgctgtagggcaatttttctgcagaagccagcgcgtcaaaactgtcgcgcagttcaaacatggtgagcactttttccagcatatgcagcggcgatgccgaggcaagccccactaatagcccctgcgctttacacagcgccacagcttcgcgcacacccggcaaaagagggcgcgtctcttcgataagcgtaatcgcgcgggcaataacacggtttgtcacttcctggcgatcggggccgttccacggttgctgcgcaaaccagagatcgacaaccatatcaatgcgtagcccaagcgtgtctggcagctcatggcgccgagtaatatctacgcctaaacttgccatcacgtccagttcagcgcgatcccagagcggttcggaatcgatcagtagtccatccatatcgaaaattgcagcaagaatttgacgtggggttgacatcacaacctctcctgttgagattaaaaaataacgaattaagcgttcattatgaccatgttcttagtatatcgcccttaaagatcaggcgaaaacgggaatcaacaggtagacttaggccaaaacgacgcgtctttatcaaggggaactcatgacgtatcaacaagctggacgcattgcaatcctaaaaagagttgttgggtgggttatttttattccggcactgctttccacgctcatctcagtccttaaatttatgtatgcgcacagtgaaaagcaggaggggataaatgcggtaatgctggattttacccacgtaatgatagacatgatgcgcgtgaatacgccgtttctgaatgttttttggtacaactcgccgacgccgaattttcagggaagcctgaatatcggtttctggctcatttttattctgatttttgtcgggctggcgatgcaggattccggcgccagaatgagccgccagtcacgttttttgcgtgaaggcgtggaagatcagttgatcctggaaaaagcaaaaggcgcggaagggctaacgcgtgagcagatagagtcacgtatcgtggtgccgcaccataccatctttttacagtttttcccgctctatattttgccggtcattattatcgtgctcggctactttttcttttccttgttaggcttcatgtaaactgaaaaatgccggatagcccgtatccggcatgggctgtacctataccgcaagcagccgatccatcgctttttgcgcagtagccaggtgctgaccgccaaacagccttgcccgattaagcagggtgtagagctggtaaatcggctgcctgtcgagaaaatccagcggtagcggcgaaacggactgatagccgtcataaatctgcggtggctgatcggtatgcagcggcagcatcgccagatcgcattctctgtcgccccaatagcaggctggatcgaagatataggggccgtcagggccaagcgcgcagttcgccgaccatagatcgccatgcaaaagagaaggctgcggttgatgcgacgccagacgttgctgaacatgttcaacaatggcgtcaatattaccaaaagtaatgcctttttccgcagcgagttcaagctgccagccaatgcgctgttcggcgaaaaaagtcgaccaacggcgttgccaggtattcggctgcggcgtggtagagagcgcgttatcaaaatcgaggccgaattgaggttggtcgctccattggtgcaggcgcgccagctgttgcccaagaataaacgcattatgggcatccagcgggcggggcgagaggtagtccatgactaaaaagctgtaatcccgatccgaacctaccgcccataccttaggcacaacaacggttttactgcgggagagcagctccagctgatcggcttctgcggtaaaaccgcggagcatttctcgttcatcgcacttcacgaaaaaatcatggcctgcataacgtaaatgccatgcggcatgaacttctccgcctggcagttcattacgcagttcgatttcgccttcaccgacttgctcgcttaaaagacgactgatagcttgccacataatgtctctccccacgttgtctgccagatcataaggttagtgcaaaaatgcggttgaaaaatacgaactaacgcacatcgcggacgcgccgcggcgggaatggcacttattgtgcgtttttactccacgcctcccaggtcgccacggtaatgtcgacatccttatctaacgcgcttttcgcaagtccggcgacaagcgctttgatttcatcagcgctctgagcgctaacaaagccaaacgtattggtgccgagctcatgcacatccccttcatcgtccgttaatgtcagcaaaaaaccgctacgcgtcagatggttattgagttcgttaatctcggtcagggaatcttcatggaaggttacggtaataacataacgggtaatatcgccactggccatcgttcacctcgttgggagcaactgtgtttttaacagcggcggatgcgccgcccgttaaccgattttccgttatccccctcggcgagggggaaacgattattgcgcggaaagataggcgtatattttttgggtatcgtcacgagaacacagacgcgtaccttgattgagcgtagcagcgctgcctgccgccacaccgaagcgcaccatctcttccagcgacgcgtcttgcgccagttttaacgtcatcgcgcctaccatactgtcgcctgcgccaacagtactttgacttttcaccgggggaggaacaacctggatgcaattctcactgtctatgcccagcgccccttgcggccccagagagaccactacccggcgagccttgccgctttgcactaattcctgggccgctttacgcacatcatcaggctgcgtcagatcacgattaaccaacgcgctcaattctttcaggttcggtttcaccagttcgatatcgccaagcgccagcgcggcggtgagcgcgtcgccagagctatcaataatgcagcgaatgccttgcttctgcgcggcggaaatcagttgcgtgagtttctcgaccttaacgccgggcggaaggctgccgctgataaccagaattgccccggattcaatttccagtacctgttcttcaagctggcgaaattcgtcatcgtccagcgtggcgccgggcataacaaaacgatactgttcgccgctggactcgacgtggacgtgcaggttctgacgcgtccagtccttcgcatcgacggtagacacggggacattttcgtcagccagtagtgcgacaagatgttcgccggtagcgccgccagccgggaaaatggcggtcgcggtgccgccaagatgcgcaatggcgcgagcgacattaatacccccgccgccgggttcgaataccggcgcggagcaccgcagtttaccttcgggataaatttgcggcgtgattgttgcgctatcgagagagggcgcaagcgtcaacgtatagatacgtaccatcgttacctcctgttaggctgatttcagtctggcacttaatccccggaaagtgaaggaattaacaatatgattttccggatctttatttaaagaagtgcgatgtaaagttatataaataaatgaatgcttcgggagggttcttattcaaaaaatgaaatagtaattgattgctatgttattcggggcttcttataattcgctacctttccaggggcgtttgtcattgatccctatgaaagtttccgggaccgtcgtggtctcttttttagttgtacggactctatataaatgaagcttttgaaggcagtacccgctgtagttatgctggcgggtggcgtgttcgcgtctctgtatgccgccgccgatgattccgtttttactgtcatggatgatccctccaccgcgaaaaaaccttttgaaggtaatctgaatgcgggctaccttgctcagtcaggcaatactaaaagctcttccttaacggctgacacggcgatgacctggtatggacaacgtaccgcctggtcattatggggcaatgccagcaatacctcctctaatgatgaacgctcttcagaaaaatatgcggtaggcgcacgtaaccgttttaatatgacggattatgattatacctttggccaggccagttggctgacagaccgtttcaacggttatcgtcagcgcgacgtactgaccgccggttacgggcggcagttccttaatggtccagtgcacagcttccgttttgaattcggtcctggggttcgctatgacgaacatacggacgataccactgaaacgcagccgttgggttatgcttccggcagctatgcctggcagttaactgacaatgctaagtttacacagggggtgtcagtatttggcgcagaagacaccacactaaattcggaaacagccctcaatgtcgccattaacgaacattttggtctaaaggtggggtataatttaacgtggaactcgcagccgcctgaatctgcgcctgaacataccgatcgtcgcactacggtaacgctgggctataagatgtaatattgtaccgggttacgttacgtaacccggttattccgtggtgacgcctcagaagaagaaggtgatgtctccgttgatataagaatagtcgtctccggtgcgaaattccgacgtgactttgtttaaagaaagagaaaatgcgacgggagaatagccgatggtggcaccgacgcgatattcatccacggttttattaatatccaccgtttccatttttgtttgcagcgttttcccctgtaacgtgtagtttttatcaacttccctgcgctcaacgccagcaaatactttatagatcaatccctctttttgagtgtgtattaaccctcggcgggacagtaacccaaacccattatcagagttgaaggtcttatcatttcccagcgcaacggttgcgccgtaccccaaatactggaagagattgccgccgacagcagatacttctggatagaagcccacattgacgcccagaatatcaatagctggcgtaagggacaccattccttttgccgtgtaaccataacggttttcaatttgatcctgccaggcagggtatttttctgcgcctattattcgatgcgcccgattctgaacctcctgaccgcctgcgtcaggaccaataacgccaatatcggtacctaaacgataacgtaaccaattggtggctaatgaattccactccagtccggtatgaagaaaggcgctgaacgcgcggtcgcctttgacggcttcaggctttctcttattggcgcctgatggagaataaatatcttgcgcgatatgaaaagagagttgactggcgtcagtgagatcgtggctgtagcctaaaaagagcccggcagtataatcaccccggtctgcagccgggtgcccataaagggcatttaaggatggttgaaatatacctgcatcatcattcgccactgaaatagcaaggctactggcattggccattgtggtcgtactgagtatggcggcaatcatcgttgcgcaatagctgtatttgttcactttttacccctgaatatgaaagtgaatactcttatttttacaaagtaataagcacagcagcatgatgcgcagtgcctattaaacctttaaatataactaaactcctgccagcagcgagtcattgagaggatacgttgccttaatgttgaaaaatggtgttgaaaaacatgcgtcagatattattgaatatccatttttcattcgctatctgagtgcgagaaattattggcttcacgattatgcatataatacgatgttttttggtatcaatatgaatatcacgttgtattcttttgagctcattttctatgatggcttcgatgtttatctgttattaatttttaccgtgatagtgttgtctttaatgatgagaatatctaacggctgtcagggtaatataaccaaattattgctatctgaattattagggcagttattattaaggaagaaaaagtgaacaagaccattaatttgctaaaattactgcccgtagtattattaagcgcatgtactacatcgtatcctccccaggatacaacatcggcacccgagttaccccatcgtaacgtactcgttcagcaacctgataactgtagcgttggctgtcctcaaggaggaagccaacaaacaatctatcgccatgtctatacgctcaataataatagcgtcacgaaatttgccaactgggttgcctatagcgtgacaaaaaccagccaggcaagcggtcgcccgcggaactgggcgcaggaccccgatttaccgccctcggatacgttggccccttccgcctataaaaatgcccatacgctattaaaagtcgacagggggcaccaggcgccgttggcaggattgggcggcgtatcggactggccgtcgttaaattatttatcgaatattacgccgcagaaatccgccctgaatcagggagcatgggctgcactggaaaaccgggtgcgcgaacttgccaaacaggctgatgtatctgtagtgcacgtagtgaccggccccctttttgagcggcatatcgccacattgccagaagatgcgacggtagaaattcccagcgggtactggaaggttttattcaccggaatggcgccgtcaaaaagtgaaggaaattacgctgcatttattatggatcagaatacgccccgttcggcgaatttttgcgactatcaggttaccgtggaggctatcgaacataaagcgaagccagtgctgacgctgtggtctgctttgcctgaagcggtagccagcgaggtgaaaacgacaaaggggagtctggcgcagaagttaggttgtcgatgagaagcgctatacggcgcgtagaaagataacggagaaaccctgtcaagggtcttgatttgctatagagtgatgcaatctccctttttttagtgttaccatcatcatgccggacgaagatagcgattttcgtctgtgtcgaaggttgtgcgccaatttagcaatggttggctagatggatacacaactcactgtcaataaattcattttctctttgtatgtgatcttgcgtaataagtacaatccttcattcacatccattctcgttcgtttaaacctgtttcaccagttccgcgtcattactggtaatagcggatatatatgtttcataccgttttacattgatccctttcgcgccgtaagatgtacgtacctaatctaacttaagcagggaactgtcattcataacacagagtttattggtatcaatggtagattatattacggtgacaatctcgggatgatccgcatatgagtagatgtggattagggcggagtagcggtaggactaataataaccggcggcgagaaatacataattgaggggctattcataaatcatcatctagaaacgcaagcactatcatgaatatatcataagtaatttacgttggtaatgatggctcagcaaacccaacaagctttacaggaacaatttttacgcttcagagccaaataaaacggcggcattgccgccgtataacttatttattgtttcttagtaaaacgaatcttatatgctctgaaaaaacaaaggaagatgcaatgtataccataaaagcaatcatcaaatgctcagggaacaaccatcccatgctaacaggaatcacacttattccaatgcaaaataggaacattatgaaataatgcgctgactttgtttcctgagttttattggagaaatacttagctaggacgcctttaaatactccagatataactaaccaaactggtgtaaaaagcccgaaatctgcgtatagttcaccatacccgaaagcaggagcgccctgatttctgtagaatgcatcagggaaaaatacttttgccagatacaatgcgccaaaatcttcaggcttatcaggccaaatagccctcggaatcctcgagtaaacctcgctttccattagtaattttccgtacataaagtcaaagtttgaggaagcaacaagaacagcattacgggtataatccgagtaattcgccatattttctatcggattcccatcagtaaacgtatatgcaaagaatgccgttacaatgactgctataacagcaaacgattttaccaggaacataaatttaatttttttattttcaatatatgaaaggtaaaggatgaatgctataaatatactaaatattggtcctttgttaccatgcaagaaaataagtatacagttaaataaaactatggaaatacaaaataactttgattttttgtatgtaaagaacgcgcaaatagaagcgacaagagaaaacattaatgaaggatagaagtatataccataccctgttctggttaattcgtatattcttcttgggctaagtatatactctctgaactccatcaacactggaaggtaaatgataaaagcaaggaaggtgaataacaatgaagtaaacacataccttggtttatttttcgtgtttgatttgttgtatatgggttttctttgtgtgtaaagataagaaataacaaatgatgctatgtatgttatatagcaagtatagaaaaacaaatattccactgtataattctgcacctctgagaggtatacaaatataccttcaaacacgtacagtgtagggactgttattatcaggtatgggaccattacatttattattttcccctcaattcttacggaaagagtatagagataaactataaataataagcataatgcaatgtatgaaattataagcatatagagcctttagaaaaaatgcttagtattaaaaatattaccatcaggcaaataaggtgtggtacggaaaatcttctggcaagatattctgaatctggtagtctataatcattactcatcactatcttcccgatatcaaaaccgtgttattgacatattaacactcattaacactcctatctactgcgcctccgatagcatgaagctatcaagcatttgcagcacaaacatcaaacaatgtaaatgcttttgataattacacatgattgttactgtgtttatatacagtggcattcgaagattcatcatgaggttcccgagtcctgtaaaagactatacagagaaagagctatcactcgacgagtaattcatctcacatcgtgccgcgacatacttcaagcaacacagacgaattacaagtacggcatcataagtgagacgttgctagttatagaagcttcatagcagcatgtaatggctctttgctggtatgtgctttggaaagtgggtttcgtattgtgcgttatcgcatgctgccaggtccccatctggagaatatagatagcggtcgtcgtgaaaagctatctgatgtgaatgcctcatacggtggcagtaagccgagactcagagtgaccatgtacatcattaacgatacgcgtgccgggtagtgtgttgggattcaggttctgtagaacagaaagatgcaatctccctttttttagtgttaccatcatcatgccggacgaaaatagcgattttcgtctgtgtcgaaggttgtgcgccaatttagcaatggttggctagatggatacacaactcactgtcaataaattcattttctctttgtatgtgatcttgcgtatgggtcaccactgcaaataaggatataacatgcctgttattactcttcctgatggcagccaacgccattatgaccaccctgtaagcccgatggatgttgctctggacattggtcctggcctggcgaaagccaccattgcgggccgtgtgaatggcgagctggttgatgcttccgatctgattgaaaatgatgcgacgctttccatcatcaccgcaaaagatgaagagggtctggagatcattcgtcactcttgtgcgcatctgttaggtcacgctatcaagcaactttggccgcacacgaaaatggcgatcggcccggttgtcgacaacggtttttactatgacgttgatcttgaccgcacgctaactcaggaagatgtcgaagcgctcgaaaagcggatgcatgagctcgccgagaaaaattacgacgttatcaagaaaaaggtgagctggcatgacgcgcgcgaaaccttcgtgaagcgcggcgagacttacaaagtcgctattcttgatgaaaatatcgcccatgatgataagccaggcttgtaccatcatgaagaatatgtcgacatgtgtcgtggtccgcacgtgccgaatatgcgtttctgccatcactttaaactgatgaaaactgccggcgcatactggcgcggtgacagcaataataagatgttgcagcgtatttacggtacggcatgggcagataaaaaagccctgaacgcttatctgcagcgcctggaagaggccgcaaaacgcgaccatcgtaaaattggtaagcagctcgacctgtatcatatgcaggaagaagcgccgggcatggtgttctggcataacgacggctggactatcttccgcgagctggaggtctttgttcgttctaaactcaaagaataccagtatcaagaagttaaaggcccgttcatgatggaccgtgtgctgtgggaaaaaaccgggcactgggacaactataaagatgcgatgttcaccacatcctcagaaaaccgcgaatattgcatcaagccgatgaactgcccgggccacgttcagatctttaaccagggtctgaaatcctatcgtgatttgccgctgcgtatggcggaattcggtagctgccaccgtaacgagccatcaggcgcgctgcatggtctgatgcgcgtacgcggctttacgcaggatgatgcgcatatcttctgcaccgaagagcagatccgcgatgaagttaacgcttgtattcgtatggtctacgatatgtacagcacctttggcttcgagaagatcgtcgtcaagctttccactcgtcctgataagcgtatcggcagcgatgagatgtgggatcgtgctgaggcggatctggcggttgcgctggaagaaaataatatcccgtttgagtatcaactgggtgaaggcgcattctacggtccgaaaattgaatttaccttatatgactgcctcgatcgtgcatggcagtgcggtacagtacagctggacttctccttaccgtctcgtctgagcgcctcctatgtaggcgaagacaacgagcgtaaggtgccggtaatgattcaccgtgcgattcttgggtcgatggaacgcttcatcggtatcctgaccgaagagttcgctggtttcttcccgacatggctcgcgcctgttcaggtagtcgtgatgaatattaccgattcgcagtctgaatacgttaacgaattgacgcagaaactacaaaatgcgggcattcgtgtaaaagcagacttgagaaatgagaagattggctttaaaatccgcgagcacactttacgtcgtgtcccttatatgttggtctgtggtgataaagaggtggaagcaggcaaagttgccgttcgcacccgccgcggtaaagacctgggcagtctggacgtaaatgacgtgattgagaagctgcaacaagagattcgcagccgcagtcttcaacaactggaggaataaagtattaaaggcggaaaacgagttcaaacggcgcgtccgaatcgtattaatagcgaaattcgcgcgcaagaagttcgcttaacaggtctggaaggcgagcagcttggtattgtgagtctgagagaagctctggaaaaagctgaagaagccggagtagacttagtcgaaatcagccctaacgccgagccgccggtttgtcgtataatggattacggcaaattcctctatgaaaagagtaagtcttctaaggaacagaagaaaaagcaaaaagttatccaggtgaaggaaattaaattccgtcctgggacagatgaaggcgactatcaggtaaaactccgcagcctgattcgctttctcgaagagggcgataaggccaaaatcacgctgcgtttccgcggtcgtgaaatggcccaccagcaaatcggtatggaagtgcttaatcgcgtgaaagacgatttgcaagaactggcagtggtcgaatccttcccaacgaagatcgaaggccgtcagatgatcatggtgcttgctcctaagaagaaacagtaaggccttcaagtaacaattctgtgaagccttcgggcttcacaggctttgttcgcctatgtttcgtttattaacaatgcgaagtggaagttattaaaatgccaaaaattaagaccgtacgcggtgctgctaagcgcttcaaaaaaaccggtaaaggtggttttaagcacaagcacgctaacctgcgtcacattctgaccaaaaaagcgactaaacgtaaacgtcacctgcgtccgaaagccatggtttctaaaggcgatctgggcctggttatcgcgtgcctgccgtacgcataagccgttaacgtttttaactttttaattagaatagatacaggagagcacatatggctcgcgtaaaacgtggtgtaattgcacgcgcacgtcacaagaaaattttgaaacaagccaaaggctactacggtgcgcgttctcgcgtataccgcgttgccttccaggcagttatcaaagctggtcagtatgcttaccgtgaccgtcgtcaacgtaagcgtcagttccgtcaactgtggattgcgcgtatcaacgcagcagcacgtcagaacggtatttcttacagcaaattcatcaacggcctgaaaaaagcctctgttgaaatcgaccgtaagatcctggctgatatcgccgtattcgacaaagtcgcgttcaccgcgctggttgaaaaagcgaaagcagctctggcataagccagtgaaaagagggagcctggctccctctcttttatttactgttcagtgagttgacaattgacctgtaacccttttcaataaaggatattcggttttaccacataaggtaacgcaagcatgaacgctgctattttccgtttctttttttactttagcacctgatcccaggaggctagcgcgtgaaaaacgaaacgaaaaacagcgcaaaaaagcctcctgatggaggctttttttgtatctgaaatcgagagattacgtccaatgaaccggtgtcttcaccgacacaatgaggaaaaccatgtcacatctcgcagagctggttgccaatgcagcggccgccattaaccaggcgtcagatgttgccgcgttagacaatgtacgcgtcgaatatttgggcaagaaagggcatttaacccttcagatgacgaccctacgcgatctgccgccggaagagcgtccggcagccggggcagtcattaacgccgcgaaagagcaggtacaacaggcgcttaacgcgcgtaaagccgagctggaaagcgcagcgcttaacgcccgtctggccgctgagaccatcgatatctccctgccggggcgccgtattgagaacggtggtctgcatccggtcacgcgtaccattgaccgtattgaaagtttcttcggcgagcttggttttaccgtggcgactggcccggaaattgaagatgactaccataacttcgatgcgttaaacattccgggtcatcacccggcccgcgccgatcatgataccttctggtttgacgcgacccgtctgctgcgtacccagacgtctggcgtccagatccggacgatgaaagcgcagcaaccgccgatccgtattattgcgccgggccgtgtataccgtaatgactacgaccagacgcatactccgatgttccatcagatggaaggtctgattgttgataccaacatcagcttcaccaacctcaaaggtacgctgcacgacttcctgcgtaatttctttgaggaggatctgcagattcgcttccgtccttcttattttccgttcaccgaaccttctgcggaagtggatgtgatgggtaaaaacggcaaatggctggaagtgctgggctgcgggatggtgcatccgaatgtgctgcgtaatgtcggtatcgatccggaaatctattctggcttcgcttttggtatggggatggaacgtctgaccatgttgcgttacggcgtcaccgacctgcgttcattcttcgaaaacgatctgcgtttccttaaacagtttaaataaaggcaggataaaacaatgaaattcagcgaactgtggttacgcgagtgggttaacccggcaattgatagcgatgcgttggctaaccagattacgatggctggcctggaagtagacggcgttgagccggtcgcgggaagcttcaatggcgttgtggttggggaagtggttgagtgcgcccagcatccgaacgctgacaaattgcgtgtaacgaaagtcaacgtcggcggagaacgcctgttggatatcgtctgcggcgcgccaaactgtcgtcaggggctgaaagtagcggtggccaccattggcgctattctgccgggcgatttcaaaattaaagcggcaaaactgcgtggcgaaccgtctgaagggatgctgtgctccttctccgaactggggatttccgacgatcacagcggcattatcgaactgccggcggatgcgccgctgggtaccgatatccgtgaatacctgaagcttgacgacaataccatcgaaattagcgtcacgccgaaccgtgcggattgcttaggtatcatcggcgttgcgcgcgatgtggcggtactgaacaaagcgccgctccaggagcctgaaatggcgccggttacggcaaccatcagcgatacgctgccgattacggtagaggccgctgatgcgtgtcctcgctatctgggccgggtggtaaaaggcattaatgttaacgcgccgacgccgctgtggatgaaagagaaactgcgtcgctgcggtattcgctccatcgatgcggtggttgacgtcacgaactatgtgctgctcgaactgggtcagccaatgcatgctttcgataaagatcgcattgatggcggtattgtcgtgcggatggcaaaagagggtgaaaccgtcgtcctgctggacggtagcgaagcgacgttaaatgcggacacgctggtgatcgccgatcaccataaggcgctggggatagccggtatttttggcggcgaacattccggcgtgaacggcgaaacgcaaaatgtgctgctggaatgtgcgtactttaatccgctgtctatcaccggtcgcgctcgccgccacggtctgcataccgatgcgtctcaccgctacgagcgcggggtggacccggcgctgcaatataaagcgatagagcgcgctactcgtctgcttcttgatatctgtggcggtgatgcgggtccgataattgatgtgagcaacgaagcaacgttgccgaaacgcgccaccattacgctgcgtcgcagtaaactggatcgcctgatcgggcatcatattgcggatgagcaggtcagtgatattctgcgtcgtctgggctgtgaagtgaccgaagggcaggacgagtggaaagccgtagcgccgacctggcgtttcgatatggagattgaagaagatctggtggaagaggtggcccgcgtttacggctataacaatattccggacgagccaattcaggccggtttaatcatggggacgcaccgtgaagccgatctgtcgttgaagcgggttaaaaccatgctgaacgacaaaggctatcaggaagtgattacctatagctttgtcgatcctaaagtacaacagctcatccatccaggcgcagaagcgctgctgctgccaaaccctatctccgttgagatgtcggcgatgcgtctgtctctgtggagcggattgttggcgacggtggtctataaccaaaaccgtcagcagaatcgcgtgcgtatttttgaaaccggtttacgtttcgttccggatacacaagccaatctgggtattcgacaggatctgatgctggctggcgtgatttgcggtaaccgctatgatgagcactggaacctggcaaaagagaccgttgatttctatgatttgaaaggcgatctggaagcagtactggatttaaccggcaaactgggtgatatccagtttaaggcggagatgaatccggctctgcatccgggacagtctgcggcgatttatctgaaagatgaacgtattggttttattggggttgttcaccctgaactggaacgtaaactggatctgaatggtcgtacgctggtgtttgaactggaatggaataagctcgcagaccgtatcgtgccgcaggcgcgggagatttcacgcttcccggccaaccgtcgcgatattgcggttgttgttgcagaaaacgttcccgcagcggatattttatccgaatgtaagaaagttggcgtaaatcaggtagttggcgtaaacttatttgacgtgtaccgcggtaagggtgttgcggagggttataagagcctcgctatcagcctgatccttcaggataccaaccgtacactcgaagaagaggagattgccgctaccgtcgccaaatgtgtagaggcattaaaagagcgattccaggcatcattgagggattgaacctatggcgcttacaaaagctgaaatgtcagaatatctgtttgataagcttgggcttagcaagcgggatgccaaagaactggttgaactgtttttcgaagagatccgtcgtgctctggaaaacggtgagcaggtgaaactctctggttttggtaacttcgatctgcgtgataaaaatcaacgtccggggcgtaacccgaaaacgggtgaagatattcctattacagcacggcgcgtggtgaccttcagacccgggcagaagttaaagagccgggtcgaaaacgcttcgcccaaagaagagtaatcagatccaggcataacatccatcagggtgtattgcggcagatacgctgccatcccgaaagtagatcagcgggatgacagcgtatttgtcagcctgaaagatgacccgtataactaaaaaggccgcattgcggccttttttctttcaagtaaaggatacccaccgtaaaatcacgctacctcttttcagctgaatggataacatgctgacttttgcccgccaacaacagcgacgaaacgttcgctggcttctgagcctgtcactgctggtgctactggctacacttctgagcttatgcgcaggcgaacagtggattgcccccggtgactggttaagcgcccggggggaactgtttgtctggcaaattcgccttccccgcacgcttgcggtattgctggttggcgctgcgctggcgctatctggcgctgtgatgcaggcgctgtttgaaaacccacttgctgaaccgggtctgctcggcgtttcgaatggggccggtgttgggcttattgccgccgtcttactggggcaggggcaactgccaggatgggcgctgggactgtgcgctatagccggcgcgctcattattacgttaattctgctgcgttttgcgcgccgccatctctctaccagccgcttgttgttggcgggcgtcgcgctgggcattatctgtagcgcgctgatgacgtgggctatctatttttccacctctttcgatctgcggcaattaatgtactggatgatgggaggatttggcggcgttgactggcagcagagctggctaatgattgcgctcatcccggtactgatctggatatgttgccagtcgcaaccgctgaatatgctggcgctaggggaaacctcggcgcggcagcttggcctgccgctgtggttctggcgcaatttgttggtcgtcgccaccggctggatggtgggcgtcagcgtggcgatggcgggggcgattggttttatcggtctggttattccgcacatcctgcgcttatgtggtttaaccgatcaccgggttttacttcccggctgcgcgctggccggggctatcgccctgctattggctgatgtggtcgcccgactggcactggcgtcggctgaactgcctatcggggtggtcaccgccacattgggggcgccagtgtttatctggctgctactcaaatccgcgcgttagcgcatcggtaaacaactgctttcatcattcgcagtctatgattaaaggctaacgatgaaacccgctattctaccgacatcagggagacaccatgcaaaactcgcttcttaatactcacgttacgacgattgatggagaggtcactacacttgaaaaatacgccggaaaagtgctgctcattgtaaacgtcgcctccagatgtggcctgacgccgcaatatgaacagttggaaaatatccaaaaggcgtgggcagatcaggggtttgtcgtgttgggttttccctgcaaccagtttatggggcaggagccaggcagcgaagaggagattaaaacctattgtgccagcacctggggcgtcacgttcccgatgttcagtaaaattgatgtgaatggcgacgcgcgccatccgctgtatcaaaaactgatagccgctgcgccaacggcagtcgcgccggagaagagcggcttttacgaacggatggtaagcaaagggcgtacgccactctatccggatgatattctgtggaattttgaaaaatttttggtaggccgggatggtcaggtggtacagcgtttttcgccggatatgacgcctgaagatcctattgtgatggaaagcataaaaatcgcgttggcaaaataatgtctcaattgatgcaattaaaggatgtcgccgagagcacccgcctggggccgctttccggcgaagtaagcgcaggagagatccttcatcttgtcgggccgaacggtgccgggaaaagcacgctactggcgcgtatggcggggttaacctccggcgaggggagcatcaggtttggcggagcgccgctggaggcatgggcgacggcaacgcttgcccaacaccgcgcttatcttgcgcaacagcaaaatccgccgttcgccatgccggtctggcattacctgacattgcatcaacctgataaaacgcgaaccgggcagcttaacgaggtggccgatatgcttggattgggcgacaaactggggcgaagcgtgaatcagctttccggtggcgagtggcagcgtgttcgccttgctgccgttgtactacaaattcatcccgacgctaatccggtcggtcaattattgctgcttgatgagccgatgaacagtctcgatgttgcgcaacaaaacgctctggatcgggtattacatcatttatgtcaggcaggaattgcgattgtgatgagtagccacgatctgaaccacacgctgcgccatgcgcataaagcctggttactaaagcgcggtaaactcattgcctgcggccgccgggaagaggtgctcaccccctcttatctggcgcaagcctacggtttgcgctttcgacgactcgacgtcgaggggcatccaatgctcatttcggccacttaagtaaaatcgtttcttgaaaagcaggtaatttcgacgctaaattaataccaaaataaaaacagaggattgttgcggcatgcgtttttggcttcttgttatcacagcattgttcctggcaggatgcagtactcatcgggcaccggcgccaaatgccagattatcagactccattaccgtcattgcgggtctgaacgatcagttgcagtcctggcgcggtacgccataccgttacggcggcatgagtcgcagaggcgtggactgttccggctttgtggtagtcactatgcgcgacaagtttgatttgcagttgcctcgtgatacgcgtgaacaatcaaaaatcggcaccagaatcgataaagatgaattgctgcccggagatttggttttctttaaaaccggttcgggcgaaagtggtttacatgttggtatttacgatacaaataatgagtttattcatgcctctaccagtcgtggcgtgatgcgttcatcgctggataatgtgtactggcgaaaaaacttctggcaggcacggcgaatttaacctcgcagacgatataaattttatagtctatttttaacatatcgccggttgaacttatgacatctgttgtcatcatatataatgatataaccgtagcatttacaaacgtacttttattaaaaacgggcgtgttcacgccctgtgaaaagtacaagattgaatattggtttataatcagagtaagttaaaaaaaggaaccggttcaccggtaaacaagaaaaatgatgacgcttcaattagtatctgaagttacgtctgtttccgtccgtagtgactggatggcgaatagcgccctaaccatgggactggcgtaatgattgcttcacttgatgagctttaccattccgaactctttttccttcccgtcatggatgaaaacgctcggcttgttggtttagagattattgcaacgtttgccgctgaagacggcgccgtgcggatgccgactgagttggtagcgcctcgcctttcggtggaggaacaatactgtctgtttgttgaaaaactggcgttgttagaaacctgtcagcacttttttattcagcataaacttattgcatggcttaatttaccgcctgcaattagtgacttattattattagatagcgaacttttttcccgggcagcgcgctttccgtttcttgaattagctataaatgagaattatcctgggttaaaccagggcaaaaacaatgaaacgttagctaatctggcaatgcatttcccattaatgctggcaaattttggggcaggcgaggcgtcgactaaagctattttcgatgggcttttcaaacgagtcatgttggataaaaattttattcagcagcgagctgaaatgatctcattcgaaccattcatgcacgctattgttgcccagatctcctccagctgcgagtcgctgatgattgccggtattgatactgaggcgatgtttgcgcgcgcagcgccattggggtttagcgcattccagggcggactatggcctccggtgccggtaagccagctcattaaactcgttcagcgataacctttctgtttgccggtgtttaaccggtgattaaccgtctacactgaagacaggaggccctatgaccctgtcttttactgcccgttggcgcgatgaattgccagcaacgtataccgcgcttttacccacaccgttaaaaaatgcgcgactgatttggtataacgacgaactggcgcagcagttagccattcccgcttcgttatttgatgctaccaatggcgctggcgtttggggcggcgaaaccttattacccggtatgtcgcctgtcgcgcaggtatatagcgggcatcagttcggcgtctgggcgggacaactcggcgacggacgcggtattttgctgggcgaacagctcctggcggatggctcgacgctcgactggcatctgaaaggcgccggattaacaccctattcgcgaatgggggatggacgcgccgtcctgcgttcaaccatacgagaaagccttgccagcgaagccatgcattatctgggtattcccactacgcgcgcgttatctatcgtaaccagcgatacgccggttcagcgagagacgcaggaaacgggcgcgatgttaatgcgtctggcgcaaagtcatatgcgttttggtcatttcgaacatttctactaccgccgtgagccggaaaaagttcagcaactggctgatttcgctattcgtcattactggccgcaatggcaggatgtcccggaaaaatatgctttgtggtttgaagaggtggcggcgcgtaccggaagactcatcgccgagtggcaaaccgtcggttttgcgcacggcgttatgaatacggataacatgtcgattctggggctgaccatcgactatggtccctttggttttctcgatgactacgatcccggcttcattggtaaccattccgatcatcagggacgttaccgcttcgataatcaaccgtcggtggcgctgtggaatttacaacgtctggcgcagacgttaaccccttttattgagatcgacgcgttaaacagagcgctggatcgttaccaggacgcgttgttaacgcactatgggcagcgaatgcgccagaagctgggcttctttaccgagcaaaaagacgataacgttttactgaatgaattgtttagtctgatggcgcgcgaagggagtgattatacccgtacatttcggatgttaagccatacggagcaacagagcgcctcctcgccgttgcgggatacgtttatcgatcgcgcggcgtttgatgcctggttcgatcgctaccgggcgcgattgcgcacagaggcggtggatgacgcgctgcgccagcagcagatgcaacgcgtgaatcctgcgattgtgttgcgcaactggctggcgcaacgcgcgatagatgcggctgaacagggagacatggcggaactgcatcggttgcatgaagttttacgtcaaccttttaccgatcgagatgatgactatgcccgccgaccaccggagtggggaaagcggctggaggtcagttgttcaagttagcctgatgccagcagcatcgtctgctggcggagcgctatttggttaacagtagcttcccggcctgagttttgcgcaacagatactcctgaccgttgtgatcgataatgactttgccgtccggacctaatagcgcctgactgttgacgcgccgttcagcggcagggagaagcgtttcattgtctatttccttagggtgaggcagctcggtgttatccatacgcgacatgctatttattaataatcaaactcacaatgattattattatcaataattaatgcgataacagcaagtgctaattctgcggagtgatatacgcgcgcggagagaaaagggcgggtaacgcatcgaagaaacgcccatcccggcaggatgggcgagctattaaaagcggctgtctaccgccgcggcaagtttttccaacaaaacttccgtatcttcccagttcaggcaaggatcggtaatggactgaccatagattaatggttgaccgctgataattttttgcgtgccttcccgtaaaaaactctctgccataatcccggcaattgccgtggagccattacgaatctgctggcaaatatcatcacatacctctaactggcggcgatgctgtttttgacagttgccgtggctgaagtcgacgaccagatgttccggcagatcaaattcatgcaacgtatcgcaggcggcggcaatatcttcagcgtggtagttcggttttttaccgccgcgcatgatgatgtgcccatacgggttgccactcgtctggtagatagtcatctgtccgtctttatccggcgagagaaacatatgactggcgcgggaggcgcgaatagcatcaacggcaatgcgggtattgccatccgtaccatttttaaagccgaccggacaagagagcgcagaagccatttcccgatggatttggctttcggtggtacgcgcgccaatcgctccccaactgatcagatcggcaataaactggccggtgaccatatcaagaaactctgtggcggtcggtactcccagttcgttcacctgcaatagcaagcgacgcgccagttcaagcccataattgacgcggtaactgccattcaagtcgggatcggaaatcaggcctttccatcccacgacggtgcgcggtttttcaaaataggtgcgcatgacgatctccagacgcgcctgatgcttttggcgttgtgcctggagctgcgtcgcgtattccatggcagcattcagatcgtgaatcgaacaggggccaatgacgaccagtagccgtggatcttcaccatttaaaatcttttctatccggcgtcgggagtcggtaacgtgactggcgacggaggacgatacaggataccgctgcgcgagttcggtcggtgttaccaggctgtcgatacgcgcagtacggagttcgtcggttctgttcattacaagtctcagaaatttgttgcttcaacggcaggactaccgggaagtgatgggcatcacgataaaccaatccctgctgatttcaagtgcgaggcgtgtcacacctcgcaggcagaacggcatgataacaaaaaccaacccattaaactagtttgctagtacatcctgcggttaagccccataatatcgagaatcttggtggctatctcttcaacggaataattagtgctgttcaggcaggggatctgattcttacgatacagcgcttcgacctccgccacttccatgcggcactgacgcaacgaggcatagcgactgttttcacggcgttcttcgcgaattgccgccaggcgttcagggtcaattgtcaggccgaacagtttatgttgtagcggttttaacgatgtgggcagcgtcaaattatccatatcatcggcgatgaaagggtagttagccgcacgaataccgaattgcatcgccagatagaggctggtgggcgtttttccacagcgcgaaacgccaagtaaaatgacctgagcctgatcgaggttgcgcaatgaaatgccatcatcatgcgccagggtataatcgatagcggcaatacgggcgtcatacttgttcaggttacccggattaagcccatgagtacgatgagcgatcggcgtcggatccagtttcatctcctgctgaagcggcgccaccagcgcctggacgatatcctggcagaaaccttcgctctgtaagatgatggcgcgaatttcaggtaaaacaatcgagtaaaacaccagcgggcgaacgccggtttgctgataaatggcgtcaatttggtctttgacggcgcgggcgcgactttcgttttccacgaatggcagcgtgatgctgctgatcgtcaccggaaactgcgacataaccgcgtgacccaggacctcggcggtgatggcggtaccatcagaaatatagaaaacatggcgatcaacaacattatccattctgttcatcctgaagagtaaacataattatctgaaagcataaattaaaagtaacgggaaacgtataacttgtcgcttattttataaaatgacagggactttttataattaatgaaaagtgtgtttcatttcctggaaacgcagtttataccgggggttattcagggaatgccgtgctatgcgcgggtttgcgcaactacgtaaacaatctgaaaaaatgaaaaaataaatttgcttgaacgattcaccgtttttttcgcgggtttaagtatgccagggtaaatacgcaactatgtgtttcttaaactcgttcatttatcacaaaaggattgttcgatgtccaacaatggctcgtcaccgctggtgctttggtataaccaactcggcatgaatgatgtagacagagttgggggcaaaaatgcctccctgggtgaaatgattactaacctttccggcatgggcgtatccgttccgaatggttttgcaaccactgccgatgcgtttaaccagtttttggatcaaagcggcgtaaaccagcgcatttatgagctgctggataagacagatattgatgatgtctcccagctggcgaaagcgggcgcgcagatccgccagtggattatcgacactcctttccagccggagctggaaaacgccatccgcgatgcctatgcgcagctttcgtcggatgatgaaaatgcctcttttgccgtgcgttcctccgccacggcggaagatatgccagatgcttcgtttgcgggtcaacaggaaacgtttcttaacgttcagggcttcgacgcggtgctggtggcagtgaaacacgtatttgcttctctgtttaacgatcgcgccatctcttatcgcgttcaccagggatatgatcatcgcggcgtagcgctttccgctggcgtgcagcggatggttcgctccgatctcgcctcgtcaggggtgatgttctctatcgataccgaatccggctttgaccaggtggtctttatcacctcggcatggggactgggtgaaatggtggtgcagggcgcggttaacccggatgaattttatgtccataaaccaaccctggcggcaggccgtccggccatcgtacgccgcaccatggggtcgaaaaaaatccgcatggtttacgccgccacccaggagcacggtaagcaagtgaagattgaagatgtgccgcaggaacagcgcgacattttctcgctcaccaacgaagaagtgcaggaactggcgaaacaagcggtgcagattgagcagcactatggtcgtccgatggatatcgaatgggcgaaagacggtcataccggtaagctctttattgtgcaggcacgtccggaaaccgtgcgctctcgtggccaggtgatggagcgttatacgctacatgcgcaggggaaaatcattgccgaaggtcgtgccattggtcatcgtatcggcgcaggtacggtaaaagttattcacgatatcggcgaaatgaaccgtattgagcctggcgatgtgcttgtcaccgatatgaccgacccggactgggaaccgatcatgaaaaaagcggcggcgattgtcactaaccgtggcgggcgcacctgtcacgcggcgattatcgcccgcgaattgggcattccggcggtagtcggctgcggcgacgccaccgaacgcatgaaagatggcgaaaaagtaaccgtctcctgcgcagaaggtgataccggttatgtgtatgccgacatgctggatttcagcgtaaaaagctccagcgtagataccatgccagagctaccgctgaaggtcatgatgaacgtcggcaacccggacagggcatttgactttgcctgcctgccgaatgaaggcgtaggtctggcgcgactggaattcatcattaaccgtatgattggcgttcacccgcgtgcgctgctggagtttgacgaccaggatgccgcgctgcaaaacgacattcgtgagatgatgaaagggttcgactcgccgcgtgaattttacgttggtcgactgacggaagggatcgcgacgttaggcgccgccttctacccgaaacgcgtcatcgttcgcctgtctgactttaagtccaacgaatacgccaacctggtcggcggcgaacgctatgagccgcatgaagaaaacccgatgctgggcttccgcggcgcgggtcgttatgtcgcagaaagtttccgcgattgttttgcgctggaatgcgaagcggtgaaacgcgtgcgcaacgatatgggccttaccaacgtcgaaatcatgatcccgttcgtgcgaacggtcgaccaggcgaaagcggtcatcgaagagctggcgcgccaggggcttaaacgcggcgagaacgggctgaagatcatcatgatgtgcgagatcccgtccaatgccttgctggctgaacagttcctcgagtattttgatggcttctcgattggttctaacgacatgacgcagctggcgctggggctggatcgcgattccggcgtggtgtctgaactgtttgacgagcgtaacgacgcggtgaaagcgctgctgtcgatggcgatccgcgcggcgaaaaaacagggcaaatatgttggaatttgtggtcagggtccgtccgaccatgaagactttgccgcctggctgatggaagaggggatcgacagcctgtcgctgaacccggacaccgtggttcagacctggctgagtctggcggaactgaagaagtagtgtaataccggatggcggcgttaacgtcgccatccggcaatttataccgcagtgtgctcctggcgcagccgctcaataatatcctgccgcaacagaaacttctgcactttgccagaggcggttctgggcagtttttctacgatgacgatccgttccggatatttatacttcgctacccgttttcgactgaaaaaagcgatcacctcttccagcgtcagcgaaaggtgtggcggttttaagactacatacgcgcatgaacgttcgcctaagcgttcatcaggcatagcaacgacgcaagcatcgtgtatgcgggggtgttgcaataaaatatcctccacctcgcgactgctgatattttcacctccacgtataataatatcctttttgcgcccggtaattttgatataaccgtcttcatccatgcggcagaggtcgccgctgtaataccagccctcattatccagtgcgcgggcggtaagttccggctcgtccaggtatcccataaaaacgttcggcccgcgcgaggcttcttcgccttcgtggcctgctggaagcgtattgcgatcttcatccacgattttaatttctacaccggtggcggcataaccatcggtgttcatcatgcgtgaagtcgaatcacccagattaaccatcgagtgtggagaactttctgtagaaccgtaaatactcaataatttgataccgcgctgctggcagtcgcgggcaacctttttgggaatagtcgtgccgccgcataagaagaatcgtagtgaggagaggtcggcaggctgttgctcaatggcacaaagcagatcgtaaataaacggcgtcgcgcctgacatacaggtacagcgttgctgcgctaataaggtaaggcaggcttctggggtaaagatgtccagcaatacgctacgcgccccgattaaaaagggcgcggtgacgccgtgtaaaaatccggtggcgtggcccagtggcgcaggcatcaggaacacatcttgccaggttaaattcaaccgcgcgcaatacgcccgttcgctggcaagaatattattgtgggtcaacatcacccctttcggcattccttctgtgccggaggtaaacagcactgccgccagttcatcaccgtgaatgttaatgtctgactgcaacggttcgctgcggtcgatgatttgactaagcgcaagcgctgtggtggcaggcgccagtttatccacgccgacaatatgcgtcagatggcgcagttgattttgtagcggaaggataagatcgaccggacgattctgtttgaacacggtgggggcgaagaatattttagcctgacatttgttcagcacccaaaccagctctgcttctcgccaggcgggaagtagcgggacagataccgcgcccgttttcaggcaggccagataaatgagggtaaactcacaccagcccggaagctgaaaggccacgcgatcgcccggttgaatcccctgagacagtaaccagtttgccaggcggcttgccgcgtagtcgagcgcggcgtaggtccaggacgcgccatgattatcgaccacggcgattttatcgggtacggcgcgtgcggtttgccgccagtagtcgcccagtgaagcatcgccccagtagccggactcgcgataggttttccgccttgcggcgtcaaacgttaatgtaacactcattgacttgttctctattaatacaaatgacgtaatctccgggggcaagccgaataagacgccgtagcgtcgttatccggtgtttcagagcgtcagccgtagcgaaactcaacgccgaacgttcccgccgggtattcccatttttcgagaagagtattgccgcagagaaccctgcaggtcccgcattccaggcagcccgcggagtcaaaatgaatatttcccgcatcgtccagcttatagagtccggcagggcaggcttttattaatttattaaactcctgcatgtcaggcgaggagcgcaaaatgatatgtgggtgtccttcatctacgtaaaatttatttacgcccaatttgacgtcaacattcaccttattgtccgaactcataatgccgtagccccttttatgccgtcttttaatagattcaccagtccaatttttttcgcatgtgacaggatagttttacgcaacggtgggactggaccgccatcaacggtgaacagatcgcccacaatgtttgccgccatacgcgggtactcggtaaaaagccgtgggttttccattaatccggggagtttgcggaaatgccgcatatcgcgtaacacgccgtttttctccagcgcgcgtttgtaaccggcaagactcgcggcggaaaaatcttgccgcgctttagcgtcaatggcggtttgagcggccgcttgcgcggacgcgatggctaaatccatgccgcggacggtatagccgagattcagacaaagaccggcggcgtcgccgacaatcatcacgccgtcatttgccagctccggcatcattgctatgccgccttcgggcaccatatgagcggagtattcaagcagtgttcccccctgaatcaaagggcgtattgccggatgctgtttaaaatcttccagcatttgcggtacgcttttggtcgcgtgagcaatgtcgcccaggccacataccagccccagagaaaccgaatcgcggttggtataaagaaacccgccgcccatgagcccgttggagggcgcgccagcgaataaccaggcggcgccttcatgggacgccagattaaagcgctcttcaataagtgccggagagagcccaatcaactcttttacgccgactgcatagtgatgcgcagaagagacaggcaccatgtccagcgaacggcccagcatggaattcacgccgtccgcgagaatcacaatattcgcatccagaatatcatccccggcctgaacgccagtgacgcgattgccttcacgtaccagagcgtcgacccgtacacctgggataaactgcgcgccagcctgttccgcctgcgccattaaccacgggtccagtttgttgcgcagtacggtatatgacgtaaggggcggagtagggggcgcgcggtgaaaatcaagtgtgacggcgctttcttcggttaaaaaggagattttttcacgggtaacgacgcgttcgatgggggcggacgttgcgaatcccggcataatactttcgatactgtgagcgtagagccggccaccggtcatatttttgctgcccgcgctgtttccgcgttcaataaccagtacatccagtcccgcttttgccatcacatacgcggcgaccgttcctgctacgcctgcgcccaccacaatagcgtcaaatttatcatccgacatgctttatgctcctttcccgccgtatcgacgacgggagatgtgcgttgaaaaaggaattagcggcttaactggtcgatgagggcaggaacaaccttatagatatcgcccaccaggccataatcggcataattgaaaatgggcgcgtttttatctttgttaattgcgacaataatttttgcgccgtttccacccaccatatgttgaatttggccggaaatgcccagcgtcagatagagatcggatttcaacagaacgccggatacgccaatataacgctcacgttccatccagttttcaccttccgcaatggggcgggaacagcccacttctgcgccgaggacggtcgccagtttatgcaccatatccagatcgctttgcgccgccagacctcgtcctacgccgatgacccgtttggctttgctcaaatcgacgctgcttaacgatttcgcgcgccgctgctggcacaatacctcgtggcgtggggcaatatatgccagcgtggtctgcgggcaagtatgaccggggagaggggcggcgggttccagtacgccgggtgccagcgtaataatcgcctgcggactgtttaatttctctttgccgaaagcaagtccgccgtacatgcgatgctctgcgtgtagcgtcccgtcgaggaggtcaatagacgtcgcgtcgttcaccatcacggcgtcaagctggatgctcagccgggcgcccagcgctttacagcgcttggtcgccgccatgagcagcagcccattttggtcgcctaataacgaggccagcgtttcggcatagttttccacgcgctgcaaatccgtatgcgattcaagaatgactatctcatcagcgccaagcgctttcacgtagtcgatatccgtgtttccttgcacgatggcgtaaactttttctccccactgccgcgcgccggtcattaattcggcataacgctctacgttatcgctaaatacccatacgttagctaaatgattcatgataatttttctccgttgggcttagttcagggattttttcaaatggtcggccagtgcggtaatggcttccggcgaatcgttatcgagaatgatatgcttgcgttctgtctgcggcggtaccgagatggcgaccagttccgccattggcgtggttggggtccagtggatatcgctcgccagccacgacgtaacggcttttttcccggcgccgagaatggctttcattgacgggatgcgtggaacgttaatatctgaggtcacgcaaagcaccgcgggcagcgtgagctcgataatttcaacgtcttcttccagtgtgcgttcaacgatgattttgtcgccgtcgcgttgaatatggcttactgcgttgatgacggggagtttcaggagttcgccagtcagcaggcccacctgttgggcataaatatcgccggagccctctccaaagagcaacaggtcaaagccgattttctccgccgcggatgctagcgccagcgcggtttctttgggcagggcgtgctccatttgcgcatcctgaaccatgaaaagcgcatctggcccgcgggataacacatctttgcggacttttgaattttgtaacagagagccgccgacggtgagcgcggcgatctcgtcgccaccgccagctaactgcgcggcggcctcaattgcatttaaatcaaactggctgattttggcctcggcacgatcaaaattgagcgaatgctccggggtcacggtaatgtcctgttcttcaggcaccaacttaaagcaggttattattttcattgcatctccagtgagtcgcgtgcggataagtaacgtaaatctgactgaaaatagtctgcggcagtctgaagaggtttacgatgggtcaatctgttttccttgccaacaatcttgcacaaaaaatctgcgaacagagaatcgttagcaaccatctgaaaagggcgtcataaaaatataaatacggtagtgagaataataagtgcgaagcatatcatcattttttaacatgaaacgtgcgatgttgtttctgtgaggttaaaagaaaacatcaaagatatgtcggctatgtatttttgtctgataatacgctatcgacaggtaatctgagctgtctgcaaaagaacataatatcttgcattcggaacgaataatcttgttttgctggtaatctccacggttgtacaacactgacgctcgctttattttatcctggttatctttttaaacctgacagaggttattatgtatcagcgctgttttgactccgccgcggagacgatttttgaacaggacaagacccctcgattttcacgttttgtcattagcgatgatccaaactgggagtctggccatcatatgcatgataatgaaacagagcttatttacgtcaaaaaagggatagccaggttaattattgactcttcactctacgtcgcgcatgcggacgatattgtcgtcgttgagcgggggcggctacacgctgtagcatccgacagcaattcgccggctaccacctatacctgtgcgctgtatgggttttgttttccaggttgggaagaaaaccaactattgcagagtcattcctgtccggtggtttccgtggttcagggaaaaggggtcattaaaagtatctttaatgaattaagcgtgttacttccgcaggggaaaaacgtattggcttcctctgtatacgatgcatttgcttacactctgaccgcactttactatgaaaattttaaaaacgcctatcgttctgaacaaggttacattaaaaaagatgtattaattaaggatgtacttgtttatctcaataataattatcgtgagaaaatcacgcttgaccagctatcgaaaaaatttcgcgccagcgtcagttatatatgccatgaatttgccaaagaatatcatatatcccctatcaactatgttattcaacgacgtatgaccgaggccaagtttgcgctgacaaacactgagtcgccactggcagaaatttcatggcgggtaggatatgaaaatgtggaccattttgccaaattgtttatgcggcatgtaggatgttctcccaacgattatcgtaagcaatttaaaaatagtctggttgagcaggcgtatttgctgccaaatacctgacggcgaaatatatctgatttattcggcctgatgccgtaaagcagtcaggccgaataagacgttccggtacgatccttacttgttctgatagtctttcagaatctggcgtcctgccacatagatcataatttcatccgtgccgccaccgatacgttcgcagcgaacatcgcgccagaagcgggagacacgggcttcgtcagtataaccaagcccacccataatctgaatcgcatcgtcaatcacttccatcgctgtgcgtgcgcagtacagcttagccagcgcggcgctggtacgcagtgactcttcccgatcggcctgccaggcgactttcaacaccatattgcgcatgttttcgattttgatggccattaacgccagcttttcctggatcatctggttatggccgatgggtttaccaaaggcgatacgctggttggcgtaacgggcggcatcttcaaatgcgcattcggcgaaacctgtactgcgcgccgcattaatcaaacgctccatctcaaaattgtacatgacattgaggaaacccatgccttcttcaccgacccggtcgctttcgtccacctcgacattatcgagataaacttcgcatgtactcaacatgtgccagccaattttgtgcagcggattaatctttatgcccggtttatttgagtccacccaccaaagcgtgaacgcttttttaggatcttttggctccgtatcgcgcgccagaaccagcatgtaaggatattcttttgcaccggtgataaatgttttttggccgttaagataaaccttgccgtttttacgcgtccaggttgttgtggcgctattattatcagagcccgcgccaggttctgttaaggctagcgcatatgctggatcgccggtggccagagtactttctgctgttttacgcagttgttctgcggaaccaaaacggcgcatactgtgaatgcattggccgttggtaatcaaaaaggccggagcgccgcattttgagatttccatcagcgccagcatttgcgttacatagtcagccggaatgccgccgaattcttccgggacgcccagcatcgaaataccgttttccgccagcgcctgcataaattctttgggataggtgcccgtttgatcgcaggtacggaaatactcttccggaaaattgctggtgattaactcgcgaatactggccagtaatagttcttgttcttcagttaatgaaaaatccatatttgtactccttttaatgtgttgcgtcaggaagcgtgaatcccatagtgctatcggtaaataatcttgtgtccatcagttttaaatctggtgagataaccggtgaaaaatccatcttgtcaagaatatcccgttgcagatcgacgccaggcgcaatttcaattaaatgcaggccatcttgtttgagagtgaaaaccgcacgttcagtgatgtaacgcacgtctaacccgcgctcaagcgcaatttttccactgaacgtaatttccggcagttcgctgacgaattttttcacgcgaccttcctgcagaatatttaatttgccatcggtaatttcagtttttaaacttccggccgtcagagttccgcagaaaataattttttgcgacgttgcgctaatatcgataaacccgccggtgcccataattttgccgttgaatttatgtacaccgacattaccgtgttgatccacttcggcaaaacttaaatagcagacatcgagcccaccgccgtgataaaaatcaaattgtgaggtcatatcaaggatcgcgcgggtgttgacattagcgccgaaggccacgccctgagaggtaataccgcccaccgggccagtttctacggtcagcacgaagtcatcggcgcagccttcctcgcgagcgaccagaccaataccgtcggcaatgcctacgcccacattgcctaccgcgcctttacgcatttcaaacagcgcgcgtcgggctaccagcttgcgctgattaaggggtagggtaagctgcgtactatcatcaagagtgaaatccccggagataaatcggttcaccggcgcgccgccatagagttgcgtctggtcggcgtcgacaaccacaatatccaccagatagccgggaatacgcacggattttggatgcagcgtggctttttttaccattttctgcacctgcatcattacaataccgccattattgtgaacggcctgggcgatcaccagcgcatcaagatacatcacctcatcttcaaatgatgcatagccttcgctgtcgcaggtggtggcgcggataaaagccacattaggcgctatcgctttataatagagatattctttattatcgatctctaccagcttaatgagatcttctttagtcacgtcgtttaattttccgccctgttggcgagggtcgacaaaggtaccaataccgatatcgctcagaatacccggctggtgtgcggcgctggcgcgcagcgtctgggttaatacgccttgtgggtagttataggcggcgattttattttgttcagccagttcagaaatacggggagattgcccccaatgtccgcatagcgcccattttaccagtccctcctgcgccagcgggctgatgccgcgatcggcgcggtcacctaatccggtagggctaataatagataaatctcgtggtgactgggttgtttgatatttatctgccagtgcggtaattaatgttgtcgcttcgagaataccgccgcctgcgcccagaatacataaagtggcctcatctggaatataatttactgcttcttgtgcagagagcacgggaacgcggccattaatgcgtgatggcttattgattttcatatttactccactattatccctgaaaacaatatcgatataaccgtgttaaggtaataaagacagcggctttcaatgaatatggaacatattcatgtcagataactatttattttattgtggcagaaagagaatattccgccacacgataaagtattacgcctggtgcaatatagttaatacggtacgcagatcggctaccgatatttgtcccggcgcagatgcttttttcaccgcgccaaacgttgccgcagaaccgaacacttcgccggcaagacgagatattaccccggttttcgacatcgacatggtaataatcggacgatccgcatagcgctcctgcatttctacagtggcggtaagtaaggtcaggacatcggctttagtctgtggcatgacggcgatcttcggaatatcagcgcccagttcctgcattttacgcagacgctgaacaatctcttccgctgcgggcgttttatgaaaatcatggttagacatgatcaccgcaacattgtgttgatgagcatagccgacggtggctttcacctcatcgtcgccggtaaaaagctcaagatcgatcatatcgaccagaccgctgtcaaccgctgcacgattcagatcgatatactgtccggtggttagcgcctgttcgccgccttctttcgcgctgcggaaggtaaatagcaagggtttatcggtaataatctcccggatggcgccggcggcctcaagtacgctttccgccgttgtcacgttggcaaaatggtcaacgcgccactccagaatatcgaaatccgcttcacggtaggcgagtgcttccgatttcacatcggtaatggtttttcccattagcgacacaatgatctttggcgcgccttcgccaaccacgagatctcttacagttacggttttcatttggtacccttcattgtcattcgtcgcaattataattttaccggtcaggctgtgaatcccatcacctgctttacatagtccaatggaaacgcttttcctgtccacagttcaaactgttcggctccttgccataacaacatgccgtaaccatcaattgttttgcaaccagcttgttgcgcctgctgcaataactttgtcatatgcggattataaacacattcggtgaccagcaattcagggcggagcagggaaacatcgccgatcagggattcgttctccaatggtttcatgccaactttggtgccgttcgtcagaatatctgcgctggcaagcgcttcagtaaaagcgtgctgatcggcaagatcggtgacggtaacgacacaatcagtgttttcattcacccgcttcgcaaaggcaaccgctttttcgaaaaagtcatctttacggttaaacagtttaatttccttaatgccttcaatagctgcctgggcgccaatggcggtagccgcgcctcccgcgccgagcagcaccatggtttttccccgcatatcgaaaccgctttctttaattgcccgaatatggcccgtaccatccgtgttgtagccgcgtagatagccgtcatcgttaacaatggtgttgatagcgccaaccagttttgctgctggcgttaattcatcgacatactcacacgcgagctgtttgtttggcatggagacgcccgtaccgcgcatttttaatgctttcagtccttcaatggcgctggcaaacgtcgtgttatccacttcgaaagccatataggtatacggtagccccgctttttctaacgctttgttttgcatttcgggcgataagctatgacggataggatacgccataagaccaattaattcatattttgcggtaacatccattttatactccttaataagtggacagtgcagagcagggcgcatgcctgttgcgcatcgttaacatttttactggaaataatgctcgccaaatcggacatcgttttgcgggatcttaaatacgcgataatagcgaataaatacaataatggcggtgataaatgtcagtagtgcaaaggcaaaatctaacaaaatgatatattgcaggccaatagtagagagataaccggtaatcagtgggataagaaagttagctacgccccccatcatcatatatatactggtgactttagctttactcttagggaaaaattccgacattaccgatacgcctaattgtaaaatacctccagcagcggaaaaaccaatcacgaaggcgccagcattacagatcagtggagagggatacaggtaaattgccgcagcggtgattgtcgccagcccggcattgaaaacattggcccagatggggcgaaccatttttttcagcaatgcggcaaaaataaacacgcaaaccaacgatcccatactgtaataagagatggttttcagcgcgtcggattccgccattccggcgaaggccatcgcatatttaggcatccagaccacaatcacatagaaggttgagaacgcggcgacgccaaataaaacggaagctacgccttccagccagacgaggggagtactgttcatctggggtaattctttcgcaatactggcatcgacaagttggctgggaaaacggcttttcaacagcatcaacgtgatgaggacgaaaaggataccggggattaccaccgcgtagccgtaccagatatggttgactagcaaggcgctgacgataaggggataaatcatttgcccaaaagagaccatcgctttaaccagaataactgccgagcccgatgctttgggaaaacactccattaatgcagggtatccgccggtatccagcgcggagttcgccacgccgacacacaccgctaatatgaaagcgatcatcaggttaggactggcgggaataccgaagaaaaacagcatatatagtacggcgccaagcagtattattgcccgacggccaaatttatcggacagtacgccaaagaataaaatactgaccagacgaccaagaccaatgccagagattaaataggcaataccggcactatccgtggagaatttctgtgcaagggaggtcatgttctgggctagtgtaataacactcatgccgtggagaaagtaactaaaataaatgcagataacagccagcaaatatggcatgttgcgagccttgttctgagacatttgttcacagctccttgctgatggtttgattcaatgtcctgcttattactgctttactacatgcagcgattgttcagtaacactataagtcggtactgtcgttatatgtacataacatggcgtttaaaatgccaggtttattgcattgatagcatttcatttgttagccaggaaatataaaaattgctgcgaatttgttgtttaatacatataactcgtgatgctcatcgcaatttttctgataagtgtgaagataatgaataataattaacacgaaaattacattttttgtttcccggtgataatggctaacgttttattttgcatagcaaggcaataatattgcaactggcacgctaacatttattgcgcggttgacgctgcttcagcgtgatgttgtgattcagcccgacttcggtaaccgatgaacagtgcgaggagaaatcccactgcggcgataccggtatcaaaccacataatatgtgcaatgctcatttctgaaatccgcgctgtgatcaacggaatagtgaacgtcgcgatactgccggcgctgtaataaataccggtcgctttacctttctcctgtggaaaacgggacgccatcagcgtcaggccgatttgtactacgccaccggcggaagagaatccaatgacgaatgcgaagatcataacaatataggtctgaggatgcaggcagaccgtcagaagcgcaataaaagagataaaggtataaaacatcaataatgtggtagagcgaattgtttttctgaccagcggggcggtaataaaaacgcagagtagcgatccgcaggtataaatacttaacagtttgatggattgggtatacgacattcctgcgacgaactgtccatactgcgccagccactggctgataagataaaaggttgccatcgagatatagccataaagggtgtagctgataagatcgatgagggagcaatgatgtacgcctgtgactggcgcttgcgagattttgggcttcaatatccgaccaggatagggtggaaaagggcagcgtaataaaaacagagcattaataagcatgatcgccccggcaagcaggaaggaccagccaaaccacatattagcccagactaataaactgataataatgggcaacaagaattgcccgccagagacaaatgctttgatcagaatatttgccgtactgggggagcgagggaaggcttccatcaaactgggataggtacctgcatctaaaaaactgttggccatacccgctaaaaagccacaggcataagcgacaaaaatcgtctgagcataaagaatgccaatgaaaaaaatcaggtaacaggtggtccccagaatgataaaaggacggcgaccaaagcgatcggaaagcataccggcgattaacaaaacgcttagccggccaataccaagcgaagagatcacaatagatacgcctgcggcactggtatgccattgctgttcaagcgatgacatgttcaggctcatcaggataacccccatgccatgtacaaagtaattaaaatacaaccctacagcggtagggaaataacgatttttcatattatctgactcagagatgccgcctgaacgttacagtggtatacacaggcaggaagcatattggatagggtgacaagtcaatgtcgtgattgtgtggctttctatccggtatcaatacgatgcggcgataaagtttacgtctaacacagccgctccagatcatgtgcgaaaagttcggcagcaacagattgataaattttccactcgataaaatccccctctgtataaatggactgaaaagaagataaatcagggaagtaacgcattgtattattgccgatgcggttatttattttgtcaacaatggcgttaattcgtcgctgtctcctggctttcatttcctttagcctggcaatgatttctggagagatgggtatgtcgccagcttcccatcgttgccaggttgccgaattattatcctgggtgatatagattgtgcattcttcaatcgtcatatcaaaaatacgccgtagtgcttgtagttctaacgcgttcatcattttttaggcttttatatgaaaaaagtgatgctataaatagcaccaccgacaccgtttcgacttgaacagaatcacactattttgtgcaatattatttgttcgttgcagatatcgcggtgttgaaggaaaacgggagctggcttatgtaacaatgcggcgaaaaaagttaaaaaaaaagcccatcgtaggagacgggcaaagactacacacagcaattcgttgtttcactcaggggatttccatgcttataaatcaatgtgttgatttataaccgtgtgctaatagtaggcatgagcactttttgcgtcgatcagattcgtctcaatagtttaaaaactgtaacggatttgcgacagaaatgagatgcggcggggaacagacgggcgaatcaaaatggagtgtgcgttgaattgataaacgtcgctaaagcatcgggcggcaatgccgcccgacgggattatgactgcttgttggcttcctcgatatcatccagctcttcaaggatctcctctggttcattcgtcggcgccggaacttcatgtacccatgcggagaacaaacgccaggtcacggccagaagcaccggtccaataaacagaccaatcataccgaatgcaatcaggccgccgattaccccggaaaggatcagaagcagcggtaaatcggcgcccatgcggatgagtaccgggcgaatcacgttatccagagtgccgacgacggcgctccaaaccagcagcacggtgccccaggtggtgtcgcctgtccagtaaagccagataatggctggaatcaataccggcaacggccccaactgaaccagacacgaaaggatcatcactaccgtcaacagagtagcgtaaggcacgccggaaatcgccagcccgacgccgccaagtaccgcctgtaccagcgcggtgaccaccacgccaagcgccacggcgcggatcgcctgggcagccagcagaaccgccgcatcgccgcgtttagccgcgagacgacaggcaaaatggcgtatacccatcgccacttgttcgccgcgccagtaaagcagggcgctaaacaacagcatcagggcgcagtgcatcataaagcgtccgatatgcgccgcctgaccgacaaaccaggtcgtggttgtgccgatataaggccgcactttcgccataatagcgctaccgcccatatccagcaggctatgccatccggcatacagtttggcgccaaccaacggaatattatttaaccatgccagatcgggtagcgtcatatcgccgccggtcactgcatggatgagcgggccgctaccatcgacaatgctgttcaccagcaaggcgacgggaataacgaagagcagcactaacagcagcgtcatgaccagtacggcaagcgagcggcggccccacaatattttttgtaatttcagcaaaacgggccaggtcgcgataacaatcgtacctgcccatgcaaaccccaaaataaaaggctgtactatccacaaacaggccacaatcatgatggctaaaaacagcaccgatagcagcacttgcgcaatatccctgggctgacgaacatttaccataaatacttttcacctttgtctttgcgccagaacgttggcgcgacgtgaacatgcaaaccacaccctataatgatgagcaatttcagcggtttttaacaggccgattctgcatgtaattctgttgggcgcacaggaaaaaaatgtgatacaacaaataacgcaacacgcaaacgattaagcatcccttcctgtgcgtagaccgctcgcgctcgccgggttgggcgccaccgttcacaacatagaccgcaggaaaaggtcaatataatgattccacaaatttctcaggcacccggcgtcgttcagctggtgctcaattttttgcaggcgctggagcagcaagggtttacgggcgatacggcaaccagctatgccgaccgtctgacaatgtcgaccgataacagtatctaccagcttcttcccgatgctgttgtgtttccccgttctacggcagatgtcgcgcttcttgcccgtctggcggcggagccgcgctttacgtcgctgatatttacccctcgaggcggcggtactggcacgaatggccaggcgctaaaccagggcattattgttgatatgtcccgctatatgaaccgcattattgaaattaatcctgaagagggatgggtgcgggtagaggcgggagtgataaaagatcagcttaatcaagcgttaaagccgtatggctatttttttgcgccggaactttccaccagtaatcgcgccacgcttggcggtatgattaataccgatgcctccggtcagggttcgctggtctatggaaaaacgtcagatcacgtcttaggcatacgggccgtattgttggggggcgatatccttgacacgcaatcgatgcccgtagagcttgcccggacgctgggtgaaaacacgacgacgccaggccgcatctatcagaccgtctatcagtcctgcctggaaaaccgccaacttatcctcgatagctttccaaagctcaatcgcttcctgacaggctacgatttacgccacgtctttaacgatgacatgacccgcttcgatctcacccgcatcttaacggggtcggaagggacgctggcgtttattactgaagcccggctggatattaccccgatacccaaagtccgccgtctggtgaatgtaaaatacgactcctttgattccgcgctgcgtaacgccccttttatggttgatgcgcgcgccttatccgtcgagacggtcgattccaaagtccttaacctcgcgcgggaagatattgtctggcactccgttagcgaattgattaccgatgtgccggataaagagatgcttggcctgaatatcgtggaattcgcgggtgacgatgaagcgcttattgacggacaggtcgaggcgctgtgccaccggctggatggcctgatggcgcgagcggaagcgggcgtgatcggctggcaactttgtaccgatttgacgggtattgagcgtatttacgcgatgcgtaaaaaagcggtagggctgctgggtaatgcgaaaggcgctgccaaaccgattcctttcgcggaagatacctgcgtgccgcctgaacatctggccgattacatcgccgaatttcgcgctctgctggatggtcatggcttaagttacggcatgttcggccacgtggatgccggggtgctgcatgtgcgtccggcgctggatatgtgcgatccgcagcaggaactgttgatgaaacagatctccgatgaggtcgtcgcgctgaccgccagatacggtgggctgttgtggggcgagcatggaaaaggttttcgtgcggaatacagcccggcctttttcggcgaagttctgtatggcgagctgcgcaaaataaaagcggcttttgatccgcataatcgacttaacccgggtaaaatctgtccgccgcaagggatagaggcgccgatgatgaaggtggatgcggtaaaacgcggcacctgggatcggcaaatcccgctggcagtgcggcagacctggcgcggcgctatggagtgtaatggtaacggcctgtgctttaatttcgatgcgaaaagcccaatgtgcccgtcgatgaaaattagccttaaccggatccactcgccgaaagggcgggcgacgctggtgcgggaatggctccgtctattggccgatcgcggcgtcgatccgttgaagctggaaaaggagttgccagaaaaacgcgccagcttacgcacgctgattgcccgcacccggaatagttggcacaaacgcaaaggcgagtatgacttttcccatgaagttaaagaggccatgtccggctgtctggcgtgtaaagcctgtacgacccagtgtccgattaaaatcgatgttccggagtttcgttcacgtttcttacagctttaccatacgcgttatctgcgcccggtacgcgatcatctggtggcgacggtcgagacctacgcgccgctgatggcgcgtgcgccaaagacctttaacttttttattaaccaaccggtggttcgtaatctggcgaaaaaacatatcggtatggtggatttacctctgctttctgccccttcattgcaacagcaactggtgggccatccgtctgccaatatgacgcttgagcaactggaacgcatgagcgccgagcaaaaagcgaaaacggtactggtggttcaggatccgtttaccagctactacgacgcccgggtcgtggcggactttatccgcctggcggaaaaactgggcaggaggccggtattgttaccgttctcgccgaatggtaaggcgcagcatattaaaggttttcttaatcgctttgcgaaaacggcgaaaaaaacctctgagttccttaatcggatcgccgcgttggggatgccgatggtgggtgtcgatccggcactggtgctgtgttatcgcgacgaatacaaactggcgctgggcgaacagcgcggcgattttcatgtgttgctggtgcatgaatggctggcgcaggaaataaatgcaagactgtccgtcgaggtgagcggcgaaccgtggtacttttttggtcattgtacggaagtcacggctttacccggcgcgcctgcgcagtgggccgccatctttgcccattttggcgcgaagctggaaaatgtcagcgtaggctgctgcggtatggcgggcacttatggacatgaactcaccaatcataaaaattcgctgggaatttatgagctatcctggcatcaggcgatgcaacgtttaccgcgaaaccgttgcctggcaaccggttattcctgccgaagccaggttaaacgcattgaaggtacgggcgtgcgtcacccgttgcaggcattactggagattataggttgatctggaaacgtgaagtgaccctcgatgcgcttaatgcgatgggggaagggaatatggttggcctgcttgatatccgctttgagcgtattggggacgatacgctggaagcgacaatgcccgtcgatcatcgcaccaaacagccgttcggcttgctgcatggcggagcgtctgtggtgctggcggaaagtatcggctcggtcgcaggttatctgtgtacgcagggggagcaaaaggtggtggggctggaggtgaatgccaaccatgtacggtcggcgcgtcaggggcgcgtacgaggcgtctgtaaagcgttgcataccggggctcgccatcaggtctggcagatagagatctttgatgaacagggacgtctgtgctgttcttcgcgtcttactacagcgattgtgtgacgttgtcaccataaaagtgtgatgcatattgcttttggtcaaaatgtgcgcagaaaaaggtgatatactgtgcacgtttacacataagcgaggatgatatgtctactgatttggacccaacccaactggcgattgaatttttacgccgtgataaaaccgaactttctcccgcgcagtatttgaagcgtttaaaacagctggagttagagtttgccgatctcctcaccctctcagcaaccgaactgaaagaagagatctatttcgcctggcggttgggcgtgcattaataaagtctgtgtaggccggataaggcgttagccgccatccggctatgttaccaggcaatctcaccagaccttgtccccaggtaatagataacccccttgattttgtttaaaaaaaatacagatcgccatttgtgctaaaaaggcgcgctctctttatgagattattcttatgccccttcaagagctaagccattaagagtgccggagataagcgccggatggggccggaacccttaagcctgtattgaacagacttaagggtttttcttttccgggcgcgtaaaaaactaaggtctgtcaataaccgccggcatgtcgtcagccgtatgattattcaaaatacggttagccagcacccctgacatcatcgatccgttaacgttcagtgccgtgcgggccatatcaacgataggttcgatggcaataaaaataccgaccagcgcaacgggaaaattcaacgtcgacaggacaatcagcgccgcgaacgtaccaccgccgccgacgccggctacgccaatagaccctagcgcaatggcaggcaacatcgcggccagaaaatgcagcgagagcggatcgatgccgatggtgggcgcaatcatcgctaccataatagccggataaatcccggcgcagccattttgccccatactggagccaaacgaggcggaaatattggcaatggtgctttgtacgccaaatttttcctgggcggaaatggccagcgggatagaggctgcgctgctgcgggaaacaaacgcaaaggttaagacgggccagaccattctgaaataacgcgctggattattaccgctgaggatcagcaagatggcatgcacgataaacatcataaaaatcgcgatgtaacaggcaccgataaaaccaagtaagctggcgaattgttcaaggcggtatgatgaaaatacggtggtcattaatgccatgacgccatagggcgttaatgcaataacgatacgtaccatcttcatgacccatatctgaatagcgttaatgcctgcgcttaatttctgaccttcttccggcgcctcttttttgacctttaacagagcgatccccgctattagcgtgaagataacgatgccgataacggaaacacttctggctcccgtaagatcaagaaaaatattagtcggaatcagcgatgtcactaactggggaatcgacaccgcggcagtcttattgacttcttccgtagttaacattgacggcatgtgcacaaaagcgctggcgtcaagccccagcacatgagcggtcagtaatccgataaaaccggcaaccatcaccaggcataacatgcatccgacgatcgtcagcgacatttttccgatgccggcactattttccagtttattgatggcggaaagaatagaaataaaaattagcggtatagcgaccagttttagcaggtggacgtaaccattgccgacgatgctgtaccattcgataatagttttagtgtgatttgctgaaataaaatgcagggataaaccaataacagcccctaaaaagatagcgataaaaacgcttttcgacagggaatcgcttttttgattaattctcaagatgacccacgagaaaaccaaaaaaagtgcgatatacgcgagcgtaacaaccatattttaagcctcttgcctcattcagcacctgaaatgccggaaagagtttacataaacctatagctcaaactgagttatagaaccgcagcggattataaagagcgcaacgccaggtatccatacaaaaaatggggttctgacctcgccgcccggcaatgtcgacagcctattaattaaatagtcattttctatacatcttttcgtttttgacctgtcagaacggttaatatcttataaatcattacttatcaaaaagttaagttgttttttgtctgtcgtatgacctggcggacagggtctatgcttaataaaaggcgctcaatatgaccatttgttggaaagcccctgcggttaaggggttgaagtgataatcattatcactaacatgctgttatatcctggtgatttagaacgcgaggtaactctatggaattgcattcagacacgtttaacccggaggacttcccctggcaagggctgacgctaacgccagcggcggcagcgcacatacgtgaactggcagaaaagcagccgggcatgttgggcgtgcggttaagcgtaaaacagacgggatgtgccggatttggctatgttctggataccgttcgggagccggataaagacgatctggtttttgaagccgaaggcgcaaagcttttcgcaccgttacaggcgatgccttttattgacggaacagaagtggattacgtacaggaagggctgaaccagttatttaaatttcataaccccaaagcccagaatgaatgcggctgcggcgaaagttttggggtataggcggtactatgtctcgtaacactgaagcaacggaagaggtcggcatctggacaggcggacgccttaattacaaagaaggatttttcacgcaactacccactgatgaactggcaaaaggcatcagcgaagaggtggtgcgcgcgatttccgcaaagcgtaacgaacctgagtggatgctggaatttcgtctcaatgcctatagagcctggctggacatggatgaaccgcactggctgaaagcgcactacgataaattgaactatcaggactacagctattactctgcgccatcatgcggaaactgcgacgatagctgcgtttcccagccgggagccgtacagcaaacgggcgcgaatacctttttgagtaaagaggttgaagacgccttcgagcagcttggcgttccggttcgcgaagggaaagaggtcgccgtcgatgcgatttttgactcggtctccgtagcgaccacataccgtgaaaaactggcggaacagggcattattttctgttcttttggcgaagcgatacacgatcaccctgacctggtcaggaaatatcttggcaccgtcgtgccggggaacgataacttttttgccgcgctgaatgcggcagtcgcttccgatgggacatttatctatgttcccaaaggcgtgcgttgcccgatggagttatccacctattttcgcattaacgccgagaaaaccggtcagtttgagcgcacgattctggtggcggatgaaggcagctatgtgagttatatcgaaggctgctccgcgcccgtacgcgacagttatcagctccacgccgcggtagtggaagtcatcatccataaagatgctgaagtaaaatattccaccgtacaaaactggttcccgggcgacaacaacacgggcggcattctgaactttgtgaccaagcgggcgttgtgcgaaggggaaaacagcaagatgtcgtggacccagtcggaaaccggttcggcgattacctggaaatacccgagctgcattctgcgcggtgataattctatcggcgagttctattccgttgcgctgaccagtggacatcagcaggctgacaccggcaccaaaatgatccatatcggtaaaaacacgcgctcaaccattatctcaaaaggcatttccgccggccacagccagaacagctaccgtgggctggtaaaaattatgccgacggcaaccaacgcccgaaatttcacccaatgcgactccatgttgattggcgcggactgcggcgcgcatacgttcccgtatgttgaatgccgcaataacagcgcgcagctggagcacgaggcgacaacatcacgcatcggtgaagatcagcttttctattgtctgcaacgcggcatcagcgaagaagacgctatttcgatgatcgtcaacggtttctgcaaagacgttttctcggaactgccgctggagtttgccgttgaagcgcaaaaactgctggcgattagccttgagcacagcgtcggttaatgatgaaggaaaaaccatgttaagcattaaagatttacaggtcagtgtggaagaaaaagcgattttgcgtggcctgaatctggagattcgccccggcgaagttcatgccattatggggccgaacggttccgggaaaagcacgctctccgccaccctggcgggacgtgaagattatgaggtcaccggcggctcggttacgttcaaaggtaaagatctgcttgaactgtcgccggaggaacgggcgggtgaagggatttttatggccttccagtacccggtagaaatccccggcgtcagtaaccagtttttcctgcaaaccgcgctgaatgccgtgcgcgcctaccgcgggcaggcgtcgttggatcgctttgattttcaggatctgatggaagaaaagatcgcattgctgaaaatgccggaagatttactgacccgttcggtaaacgtcggtttttccggcggggagaaaaagcgcaatgatattttgcaaatggcggtgctggagccggaactgtgcatccttgatgagtcggactccggactggatatcgatgcgttgaaaattgtggcggaaggcgtcaacgcgttacgcgacgataaacgcgcttttattatcgtgacccactatcagcgcatactggactacatcaagcccgattacgtccacgtcctctatcaggggcgaattgtccgttccggcgattttactctggtcaaacaactggaggagcagggttatggctggcttaccgaacagcagtaaagcgctacagcaatggcaacatctctttgaagaaaaaggagaaagtcgaactgagcaggcaagacaacatttacaacagatgttacgtctgggattgccgacgcgtaaacatgaagactggaaatacacgccgctggagggcttaacccatagccagtttatccagcagtgtgcgactatcagcgccgcacagcgtgatgcgttggcgctgcaaatcgatgccgtgcgactggtgtttgtcgatggtcggtttatgccagagctcagtgatagcacgcaaaacagcggatttgacgttagcgtcagggatgagcgccaggcgcttgccgcgccggtgcagcctgaggtttttctgcatctgacggaaagcctggcgcaatgtgtcacgtatatacaggtacggcgaaatcagcgtccgacgaggccgctactgttaatgcatatcacgcagggtgtggatggcgacgagctgaataccgcgcattatcgccaccatctggcgctggcggaaggcgcggaagcgacggttattgagcattatgtcagccttacagcggcaaaacattttaccggcgcgcgtctgacgatgaacgttgcagacaatgcgcaactgcgccatttcaaactggcgtttgaaaatgcgtccagctatcactttgcgcataacgatcttctgctggcgacagacgcctcggcgtttagccacagttttctgctgggcgccgcagtactacgtcaccacagcagctcacaactgaatggtgaaaacgcgacgcttcgactgaatagtctggcgatgccggtgaaaaatgaagtctgcgatacgcggacatggctggaacataacaaaggctactgtaacagccgccagttgcacaagaccatcgtcagcgacaaaggacgcgcggtctttaatggcctgattaacgtggcgcaacacgccattaaaaccgacggtcagatgaccaataataacctgttgttggggaaactggccgaagtcgataccaaaccgcaattagagatctatgccgatgacgtgaagtgcagccacggcgcgacgatcgggcgtattgacgatgagcagatgttttatctgcaatcacgcggcatcaggcagcaggaggcgcggcacatgattctttacgcgtttgccgcagagttaacggaagctatccatgatagcgcccttaaacagcaggtgctggcgcgaatcggccagcgactgcccggaggcctggtatgacatttcctgtagaaaaagtacgggcggattttcccatactgcagcgtgaagttaacggcctgccgctggcttacctggacagcgcagccagcgctcaaaaacctaatcaggtgattgatgctgaatctgccttctaccgtcacggctatgctgcggtacatcggggtatccatacgttaagcgcgcaggcgaccgaaagcatggagaatgtgcgtaagcaggcgtcgcggtttattaacgcccgctccgcagaagaactggtgttcgtgcgcggtacgacggagggcattaaccttgtcgccaacagttggggaacggaaaatattcgcgccggggataacattatcatcagcgagatggagcatcacgccaacatcgttccctggcagatgctgtgcgagcgcaaaggcgctgaactgcgcgtgatcccattgcatcctgacggtacgctgcggctggagaccttagctgcgctgttcgatgaccggacccgactactggccattacccacgtttccaatgtgctggggacggaaaacccactgccggacatgattgcgctggcgcgccagcatggggcgaaagtgctggtggatggcgcccaggccgtgatgcaccatgctgttgacgtccaggcgctggactgcgatttttacgttttctccggccataaactttacgggccgaccggcatcggcattctgtatgttaaagaggcgttgctgcaagaaatgccgccgtgggaagggggcgggtcgatgatctcgaccgtcagcctgacgcagggaacgacatgggcgaaagcgccctggcgttttgaggcgggaacgccgaatactggcggcatcatcggtctcggcgcggcgattgattatgtgacgtcgctgggactggataagattggcgattatgagcagatgctgatgcgctatgcgctggagcaactggcgcaggtgcctgatatcacgctatatggcccggcgcagcggttgggcgtcatcgcgtttaatctgggtaaacaccacgcttacgacgtcggcagctttcttgataattacggtatcgcggtacgaacagggcatcactgcgcaatgccgctcatggcctggtatggcgtgccggcaatgtgccgggcttcgctggcgatgtataacacccatgaagaagtggaccgactggtggcaggattaacgcgtatccaccgcttattgggataacagtgaggttttatggctgcgctaccggataaagaaaaactgctgcgtaactttacgcgttgcgctaattgggaagagaaatatttatatattattgagttggggcagcgcctggcggagttaaatccgcaggatcgtaatccgcaaaatacgattcatggctgtcagagccaggtgtggatcgtgatgcggcgaaacgccaacggcattatcgaattgcagggcgacagcgacgcggcgatcgttaagggccttatggcggtggtatttattttgtaccaccaaatgacggcgcaggatattgtgcattttgatgtccggccatggttcgaaaaaatggcgcttgcgcagcacctcacaccttctcgttctcaggggctggaagcaatgattcgcgcaattcgcgctaaggccgccactcttagctaaactgtacagacagcgttctacctgatgtcaaatcctttgtcggacggcgacgtcgctttatccagagtggatagagcgtgtattttgttattctgataagcgaagcgctaccagtcgtcgcagagggcatcaccaggaatacaggaggtttggtatgaaacgtgcgtctttcattacgctaactattatcggcgcgtatagcgcgttacaggcagcctgggcggttgattatccattaccgcccgaaggcagccgtcttattggtcagaatcaaacctataccgtacaggaaggtgataaaaacctgcaggctatagcccggcgttttgatacggcggcgatgctcattcttgaagcgaacaatacgattgcgccggtgcctaagcccggtacgctaattaccattccctcgcagatgctattgccggatgcgcccagggaaggcgttatcgtcaatctcgcggagctacggctgtattattacccgccgggagaaaaccgcgtacaggtgtatcccatcggcatcggtttgcagggactggaaactcccgtcatggacacccggatagggcaaaagatccccaacccgacgtggacgccgacggcaggcatacgccaacgttcgcttgagcgggggatcacgctgccgccggtgatccctgccgggccaaataacccgctgggacgctatgcgctgcgtctggcgcacggtaatggggaatatctcattcatggcaccagcgcgccggatagcgtaggtctgcgtgtgagttccggttgcattcgcatgaacgcgccggacatcaaggcgttatttgcgcaggtcagaacggggacgccggtaaaagtgattaaccagccagtgaaattctctgtcgagccgaatggcattcgttatgtagaggtacacaggccgctatcgccggaagaagagcaaaacgtgcagacaatgccctatgtgttgcctgcggaatttaccgcgttcagaaacgcgcaaggggtggatagtcgcttggtcgataaggcgctataccggcgagccgggtatcctgtcagcgtgagcgccgggcagacgccggcggtaaatacgaccgcagtcgaatccgctcagaacggttttgtcggggaagaggggcaaacgcgcgcgacgcagtagcctttgcagcaaacgacggacaaaaaaatggcgcacgatgtgcgccattttatattgtgcgtcaaattatttacagatgcggaatactttgttgtccagacgttggttcgcgcgagcagcatcgtctttagcagcctgaacgtcggaacgcattgcatttacgtcattactcagttgctcaactttagcgctcagcgtctgtacatcggaagacaactgatcgattttagcgttgcttgaacaacctgccagtaacgtggaacccagaactactgcacctaagatcagctggttagtacggttcataacaataacattatactttgtgtggttatgtgggtaaaaaaaatggcgcacgatgtgcgccatttttattacgcaggtactattacttacggtatttagtagcctggttgtccagacgctggttagcgcgagctgcgtcgtctttagcagcctgaacgtcggaacgcattgcgttcacgtcgttgctcagctggtcaactttagcgttcagagtctgaacgtcagaagacagctgatcgattttagcgttgctggagcaaccagccagcagagtagaacccaggattaccgcgcccagtaccagtttagtacgattcattattaataccctctagattgagttaatctccatgtagcgttacaagtattacacaaacttttttatgttgagaatatttttttgatgggaatgcacttatttttgatcgttcgctcaaagaagcatcgaaatgcatgaaagtccctaaaaaaccgaaagaaaacagggggcttccatcggattcttcttagataatccgcaattagatagtaaaatccgatttgatttttttattaatagtggctatcgattaaataaaaaaagcgccggaagggcgcttttttaaacaaattaattcacacaacaattattacagtacgtgaacagaggcggtgttagtggtgccgcttggaaccagcgcgccggagaccatcactacgacgtcgcctttctgggcgaggccgctttgcagggcgacatctttgcccagacggtagaaatcatcagtagaattgatttctttcaccagctgcgataccacgcctttgctcagtactaactgacgggcggtcacttcattggtggtcaatgccaggatggtggcgtccgggaagtatttacgcacggcgcgagcggatttaccgccctgggtcgctaccacgatcagcggcgcttccagtttttcggcggtttctaccgcgccgcggcatactgcttccgtaatgcgcagtttacggctgtcgttgttgtagtccagacggctgttcatgacgcggtcggtacgttcgcagatggtcgccatgatagaaacggcttccagcgggtatttcccttttgcggattcgccggacagcataaccgcatccgtaccgtcgaggatggcgttcgcaacgtcgcctgcttctgcgcgggtcggacgcgggtttttgatcatagaatccagcatctgagtcgcggtgatcacgactttacgtgcgcggatacatttttcgatcatcattttctgcgcaaaaatcacttcttcaaccgggatttctacgcccaggtcgccacgcgcaaccatgatgccgtcggaagcttcgagaatttcatcgaagttgttcaggccttcctggttttcgatcttagagataatctggatattttcgccgccgtgagctttcagatgctcgcgaatttcgacaacgtcagaacgtttacggataaaggacgccgcaacaaagtcaacgccctgttcgcaaccgaagatcaggtcctgtttgtctttttcagccagcgccggcagagcaatagaaacgcccggcaggttaacgcctttgttctcgcccagatcgccgttgttcagcaccttacaaatgactttattgccttcgatggcggtcacttccataccgatcagaccatcgtcaaccaggacggtgttgccaacgctcaggtcgctggtaaagccttcataggtgacggcaacgatttcattattaccgaccacggatttgtcggtggtaaaagtaaaggtttggcccgctttcagcgaaacgtcgttaccgccttccagtttaatggtgcggatttctggtcctttagtatcaagcagaatagcggcttttttaccagttttgctcatcacgttgcgcaaattctggatacgctgaccgtgttctgcataatcgccatgagagaagttcagacgcatcacgttcatgcccgcgtccagcattttgcttaacatctcttcggattcggttttcggaccgatagtacaaacaattttcgtctttttcatgacagtcttagtctttaagttgaggaggatatggaaatctggcttcgggcgcgcacggcccggaagctaagcctgtgttgctaaagtgatgatgcctcgctctaaggataggtgacatcgaaagagcgtgcagaggaatgtgtgctcgcgtttcagcccaacgggaaggggataattttagtcgttgagttttacagtccaatgcgctgaaaccattcaagagacaattggcgcgcattatacgctgaaatttacaaaaaaggaaaatgaaaaccctgtttcaaaagacatctgtgcagatccacaacggtttgttattacgctgtttacgatgtcgctggcgataacgccgcccgaacaggggcggcgttgcgcaacagcgggtgttgttgcgcataatgtcaatcgagcaactttttgccttccaggtcgatggcgatgttttggttgtgtgcttttcgatagcacagaatcgctatcccgatggccgcccagctaattccgagtatcagagcgtgaatgttcatgtttaaacagacgtagccgatgacgatcatccccatgatcggcgaaatgacatgggcgaaaatgcgccgctgggctttcatccggaaattgaacaggataaacacacacaggttcacgacaaaaaaagcgaaaagcgcgccaaagttcaccagcgtggagatagattcaatcttgccggaaaacaggtagctgagcagcagggtgacgccgccggtaaacagaatggcataatccggcgttttacgcgtggtatggacgtgagcgaggaaggcgggcaacattcggtcgcgccccattgaaaataacactctggacaccgccgtttgcgcggtaataatgttgccgacggcgcacacaaacgccacaatgatggaaaacgccactttgagccagataccgccaacgttgccggcaatggtgaaaaatgcttcattcgtcgcattaccttccgcgaagcggtcgacgttaccggtggcgaacgccgcaaacgccacaacgataataaacagtaccgtcgccaaaactaacgccaacagcgttgctttactgacggcgcgtcccccgccttcgctttcttcacttaatgtactgatagcgtcaaagccgagaaagttcagcgcagccaccgaaatcgccgtcgcgatgagccctggggtgaaccactgtgaatcgaaaaaaggccggaaggaaagcgttatctgactactgtccagcagcatcagacggacaatgagtagcacgaaaatcgccagaataccgagttgaataaagaccagtaacttatcgaatttcgccgtttgctgtatcccgagatagttgactccggtgccaatagccacataaatcaacggccagacccagaccgggatttgcggtaaaatagcgtggaccgcgacgccgcccagcactgccacgagcgtagggaacaaaagataatccagcagtaatatccatccggtcagaaaccctacggcgggattaatgcatacgccagcatacgcataggccgaacccgacgaggagatatgctgcgataaggtagagtagctgtacgcggtaaaaaacatcgcgatcgcgccaataatataaaccagcgcaaccataccgtgcgaaagattataaacgacgccataaagagagactggcgcgataggcaccataaacaccagaccataaagcactaaatcggtaagagacaattttttgacttttttcatgataaataccttaatggctttttatgccagatcgcgtaaaaacgcgcttaccgctgcgaggcagggcgcgatattttcttcatgcgggttatggctgctgccgggaatagtgaccgcgcggcagtctgaaatgtgagagagaagcggagagacgacgcgctcggttgcctgatcgttttcgccgcgtagtaccagaacaggacagcgtatctggcacaaatggggcgtaatatcccagtcggcaagtttgccatttgccgccagttcattggttccccataaaatgtgataaaccgtagggtcggcggcgaactgcgcattagagcgctgaacatgaacggcttcttccgcgagggtataaacgtgtctggcataataagcgaccagctgttccggtgggttttgataaatgacggcgggcataatgacgtttttgatatcgtcatcggacattggcgtcagagcgttaaagagccgtatggcttcctgttgccacagggcgatactggccggcgaactggccagtatcgtcccgcgaagcccggcaggctgtaagcaggcgtgctctgcggcaagcattccgccccaggaatgtcccagtatcgaatacccgtgtccaatacccaggtgatgaattaattgggttaattgacggagataacgcgcaatagtccagaaagacgcgtcagcatgaggaaaatgcgttgaacgaccgcagccatattgatcgtaaaatattaccatgcgcccgtcatcagccagacggcgataatttaataaataatcaaagccgccagaagggccgccatgaaggataatgagcggcgtgagtaatgattttctgtctccataaatccgatagcttgtcaatatgttttcagaaaacatttcgccatagagataagtatcattcatattcttaatgactcagtgtgtggcagggcaggcgaaatttatattcgcctggataatattatttttttattgtgtgtaaaacattacaccagaaggtggcgtaatgttcccattgcagaaactgcggacttccccagtgcggcgaacaatcactggcaaaacaacatactttccctttatggtaagtacccataactaacagtggatcgccattaatttcagcaaggacctgactattttctttggcgataagcttgttatagcccaacagcggcggccattcgctaaatggctgggtaataacatgctctaccgcagtatttactgctttacatccttgcggtagttctacgcggtcatctacatccagcatatcaaccggcaatacttccgccagaaccgtatttttataattggcttttgcttctattcccgtaaaggataaatacccgccgatcattaacagaccgccgccctcagcaacataatcggcgataagttgtaatgcatcaggaataatgtccatattataaaacgttctgttttgtagcaggaacgtattgctaccgatatcactgatgacgatcgcatcatagcaggctaatgcttcggcggtttgtggaaaacgagtttgcacaatatgggcaggcatgtagtccacatcgatattaccctggcgtaagcaggataataaatagtctgcaccttcttcatatttgctcgatgtaaagctatcaaaacctttagagtgaatcatatgaatgtgccaggattcgccaataaataaaattttcattatgtcacctgttaattaatgtgaatgactttattagattgggtacgcattcgatgtaaaacctgcaagtgctgaggcatactcgacgcaccgacttgttccaccgccagagaagcgaaagcggaggcatattgaatggctgcgaccatgtctgcttgtcgcgccagcgcggcggctaaggcgccattaaaagcgtcaccggccccagcggcatcttttaccacggcgctccacgcaggaatatacaacgtgcgggcgtgctcacagatcagagagccacgggcgccaagggtaatgatgacttttttcaccccggattgcagaataatatttccggctttttttgcatcattaatatcagtaatggttacaccggataaaaaagaggcttcagtttcattcggcgtgatgatgtcaatatcagataataaatgcgtcacctgtttcgtatagggggcagggttcagcatgatcattttattttcttgtttgcccagacgaataaattcagtcaacgcttcaatgttcgtttcgagctgcattaacataacgtcagactcggcgatataacggtgttgctcattaatctcttgcgtggtgagcatcatattggcgccagggtagatggcgataatattatcgccatccacggcggagacatagatcaatgcgctaccggtgggtgctttatctgtttgatacgcgctgtatgaggtgatgcctgattgaataatatgattcatagcaaatgcgctgaactgatctttgcccactttaaaaataaaatgtgccgcagcgccagcgttgtttgccgctaaagcctggttggctcctttacctccaggatagaatccaaattgactggccagaatggattctccgctttgtggaaaccacggcacggttgctgaaacatcaatattgaatgagcctaaaacacacaccttgcctgctttttttgggttttcccggcgcagttttgcatcctgatggattggcgtggcgatagtgctggagatatcaatcttattttcagtgataagcttactcagcgcgtcacggtttaaaatccctccgccatagcaacgctgaagcatacctgatttctggaaatagcgtagatcggaacgaatagtctcctggctaaccttataaaggtctgaaagtttactgacgctaacactattatcctttatcagtaaattaatgatggcatgacgtctttcttctttaaacatattgcctccgggtagtgagttgaattgtatttatggcaatgttgtcatgcggtgaattcaatcacagattatgcggtcaaccggaagtaaccccaaatgaatgtcaataatcagaagcgcagccaatgtgttaaatattaattgcttacagaaggggaaaatagttttgtgagtgttgtcatatattttctatgtaatatgacggggtgaacgtaaaatagttgggcttgcacgattcagtgagtatatgcagccggacagcgttcgcttatcagtctctaccctcgacgaaataagacgatatcgctctccggcccgggggttatatacgctcgatttttgccggcagcccctgacgtactgccgcgccagaaacccagtcgagccaggtgttggtaatggttcttgtcggatcggcaaagcccagatcgttaagatttatgcctgccctgatttgtggatcatacggcataggcacgccatccagagagtgctgcgttgcgcccatctcgcggtggccatatccgtgttcgatggcgatgacgcctggcatcacgccatttaacaaactgatttgcgccacgacctgaccgcccggcgtaatgatccgtacccgatcgccatgttgcagtccataacgctcgccgtcttgcggattcagcgccaccaggtttgctggcttcacatggtgtaagcgcgggatgacggctgttgagctggacatggtatttgatttaaatgaaatcagtttcagcggccattgcccaatgggaaactggtcgtcaatcgcacgaccatctgacaaacgcgccggataccagaccgggcaaccgctgaagcgctccccggtgatggcgtgacggtgggcggcgacatctgcattccagatctgtaagggttttttccacgcgttacctaaccgttgctccgtatagccgctatcctcgggcgcaaaccggccgccacgcgagtagataaacgccacgcgaccgacctcatcagctttaagcgtgtgctgaattgctggcagaatgcggctgacgccggtaagcgaaatatcttcctgatttgccagcgcgaccggcgtcttgcccataaaggcgatattagcggctacgcgcagatagaagtcttccgcccggttcagtggaaaagtattgccctgcggatcggttatcgcccggtcgccgaagccgggcagatggagccgttttgctaccgcaatacaaaatgcttccattgagacaggttgcccgtccgccgtgcggtgagtggcgggggcgacaaccggccagcgggcggtagtggctttactggctacgccgccccagggcgccgtaaagccccagctctcaaaattgtgcgtatccggcacaatgtaatccgccagcgccgtcgtttcattcataaaggcgtcaatcgcgataaagagcggcagtcggcgagggtcttttagtttttcttccgccacggcgcgtagaccgggaacaccgtaaaacgggttgctcatattggaaatccaggctttaagcggataaggatagccttcgagcgcggaggtcaacagttcggtaagctggcctgccacaaagggataccacggcgctttggctggataaggggattgcccaccggcaattttgtcgcggtattcttccgatgcttcataagcggttttgctacgggcaatacttaacccggacggtttcacttttccggcaaaactgttcatgttgtagcgggggccgtcgctaacgccgttgaatttgccgccgccgacaaagacgccgccggacaagctgaggttgccgatcagcgcgttaagcatcatgaccgaccaggcgttataaaacccattgccggccatcatgccgccgtgactgatgaccgcagctttacgtccgtgactggtaaaggtttccgccagcgcgataatttgcgcttccggcacgccgcactgttcgctgtattgcgccaacgagagcttttctgccgcctctttcaggcgttgcaacccgctcttcaccgtgacccgttggccgtcggcgagcgtaacgtactgcgtcacgaaaagccgtgcctgtcggcaagtggacgcatcgaccaactcgccgtcggtattcagtacgacaggggtctcttcgccatcgggcgtaagatggcgcagcgtcaggtgttgtccggcaagcgtcggcagctcatccgcaatgaccaggtgcgtggcgttggtccaactttgctcgccggcctgctgcatcgcctgtacgccgggaatcgccagataatcagcattataacgttgattatccatgatccagcggatcatccccattgccagcgccgaatcactgccgggcatgaccggttgccagcgaccgcgaggatcggcgagcaccgttgataaggggagggcgggggcgaccacgacgtattgaaaattctcacgcagtcgggcgctcgccaactgacgtgcctggcgtttaaacggattgccggactgtgccggggaggtgcccataaagagcgcaaactccacgttttcccagtcgggtttgacatgcgggtttttatccagatcgcccatcaatgccccggagccggcccggtaagccagtccacagtaggcgccatgcgcgccgaaattcttgctgccgaagctatttagcgcaaaacgacgcagaaacgcatcgcggccttcgtcgctggtattcgtgaccagtaactgattggttttgggcccgaaactggggtgctttgcgtcaattggcgtatccggcgcatgaatagcgcgcagtccgtccacatgaccttcgccaaacagatcgccgccttccacgacttcttcaataagttgctcaaagctgatgcgctgccatttcccttcgccgcgtttacccacgcgtttcatcggttcaagcagtcgtagcggactgtacaggctttccagcagcgtggcgccgcgcgcgcaggcggttgagcgggcgtcaagaccgctttctcccgccagttgctccatggcttcgctaaaagggacggacgagtcaatcgggtgttcctgcgacaaggggtgatagggattgccggcgatgcgtatcactttgccatcggcattaacccgggcgcggataccgcactgtgtccaacagccgaagcattgcgtcatggcgatggtttgttgtggattttgctgccagtgtgtttgcgcctgcgcctccggaattaacgcattgccaaagatgcggtcgcgcgttaccttgccggacgtcccgtttaacaggccatcaattgcgcgtttcgccacatcacggtagctcagaccaaaagtgaccatcccaccgacggcgagaccgacttttagccactgacgacgggttaaattagccatgttgtaatctcctggtgagtccgttcagcgtttcacgaataataatcagtagcgctatccacaggccgaaggtgccgagaatagccagccagccatccgttccgcctggtaacgagtaagggttaaattgcgcgttgaacttggggacggtttgtacctgaatcaacaatgtccagcgcatcagccaacatagcgccagcgcgctgagaaccagcaggacgcgtcttagctgtgataacggatggcgtagcgccaggctacagaacagcagtgtgcatacccacagcgctacccagccgacagcgtaatatttggctgacagggcgacggtaatccactgacggattgccgtgccggaaagcgtatcgccgctaacccacatggccacaaccagccccagcgccgccagcgtccagatttgtccccacaatatttttggcagccttaccgagtcgcgtcgggcggcgacaatcatcagcgcgaagaacgcctgtaaggcgctaagaaacatcgccacggggaaggcgtagctaaaccagattgggcgcgccagcacaacggagacttcgcggccggtataaatcaacaggcccaccgcgcaaagcgcgctggctaacgccaaccatttagtgacgttgtaacttttattgaataatcgtttaatctgctgcgccaggaaccacagagcgagaaatccggtaaacagcggcaggaataacgctccccagggcatccacgaccagggcgtcggccaggcatagaaatgccagacgcgggcggtctggtgcagatccgccgtcagcgccagcggtgcggtaatcgcacaggtaatggcaatcagtaatgcccgattttcttctgttgcggcgtcttttttccgccagtgaagataacaggcaaacagtgcggcgcaggcggcaatgccaataaaaaagaaatattgtaccgcccacggcagccagctaatgtcctgcgggtgagccagcacttcttcaatgatgagtgaatgcgtcattcagacctcctgccaaagcgcgggctgcgcacggcccattaatggggtgacaaaggcgtcgtccagacccaggtagaaaacatggggcgacgtgccgttttccggctttaataccttgatagcgtcgcgatgctgatgaagcatggtggcgatgcggctatggggatctttgatatcgccaataatacgcgcgccgccgacgcaggactctacgcaagcgggtaacagtccggcttccagacgatggacgcaaaacgtgcatttatcggcagtttgcgtttcatgattgataaatcgggcgtcgtaaggacacgcctggacacaataggcgcagccgacgcagcgtttgttatccaccaccacaatgccatcttcccgctgaaaggtggcttgtaccgggcagaccggcacacagggggggttatcgcaatggttgcacagacgcggcaacagcacattcgtgacttcctgactaccttcacgctggacctggtattggttcaccgtcgtacgaaacgcgccttgcggcgtttggttttcaatagtgcaacttacggtacaggactgacagccgatacaacgccgcagatcgataagcatggcgtaacggtgtcggggagagccttcatgccgctccggcgaaaaaggaaatttcgcttcagccagcggaaccagcgaggcgccagcggtcaggacgccaagctgctggagaaattgccgtttactgctgtccatattgactcccgtccacattgccaacaatgaaacatttgtcacgatgttggttcatgtgtaatgaataaaaaatgtcgatgatttacagtgtaaaaatcgaggcggggtgcgctctattgtggttaaccacatacccggcttgttgttgatctaaaacaacataattgacagggatattggggtgagaggtaaaaccgtaaggcgcctggcggtgttggcggcagtagggctactttgtcatggcgcgtgggcagggacgtggaatatcggtattttggccatgcgcggcgaggcgtctacgcgtagccactggcaaccgttggcaaagacattaagccaacagcttccaggcgaaacctttcacatccagccgctggatctgcatcaaatgcaggaggccgttaaccagggaaccgtgcagtttgtgataaccaacccggcgcaatttgtccaactgaacagccatgcgccgctgcgctggttagcttccctgcgctccacgcgcgatgggaaagcggtgagtaatgttattggcagcgtgattttgacccggcgcgatagcggcatcaccacggcgcatgatctcatcggtaagaccgtcggcgcgattgatgctcaggcgtttggcggctatttattaggctataaagcgctcagcgacgcgggcttacgcccggagcgcgattttcatctccgttttaccggatttcctggcgatgccttagtctatatgctgcgcgaaaaagcggtgcaggcggcaattgtgccagtgtgcctgttagaaaatatggatcaggaaggattgattaataaaaaggactttatcgcgctgctttcccgaccgacgcccctgccttgcttaaccagtacgccgttatatcctgactggtcgttcgcggcgctacctgcggtaagcgatgcgctggcggatcgcgtaacgcgagcgctattcaacgcgcccgccgccgcgtcatttcactggggcgcgcctgcgtccaccagtcaggtggaagccttgctgcgtgatgttcgtcagcaccctcagcagcgtcgactgtggctggatgtcaaaagttggttaatccagcaccagctaatggtcggcggcgtgattctggcgttcttgttgctcacgctcaattatatttgggtcatgctgctggtgcgtcgacgtggaaagcaactggaacgtaatagcgtagttcttcatcagcatgagcgggcgctggaaaccgcccggcaaatgagcgtgttgggtgaaatgacctccgggtttgcccatgagcttaatcagccgctttccgcgattcgacattatgcccaggggtgcctgattcgactgcgcgctgcagatgaacagcatcccttgctgccggcgctggagcagattgaccagcaggcgcaacgcggtgcggatactctgcgtaacctgcgtcactgggtcagccaggcgcagggcaacccggtgctaaccgaagcgtggaaggccatagccattcgcgaggcgattgatcatgtctggcaattgttgcgtatggcgcaacagtttccgacagtgactctgcataccgaggttagcgctgcgctgcgcgtaacgctgccgtcagtgctgctggaacaggtgctggcgaatatcattcttaatgcggctcaggcgggcgccacccatttatggatcgttgctgaacgcactgaaaacggcatcagtattgttttacaggataacgccgggggaatcgatgaggcgctattacgtcaggcgtttcagccgtttatgaccacccgtaaagaggggatgggcttagggctggcgatttgccagcggctggtgcggtatgggcggggcgatatcagcatcaggaaccagaccgcgccggacggtctgtcgggaacggtggttacgatacatttcttacatgaaaatgggggcagggatggcgacaattcatctactggatgatgatacggcggtcactaacgcgtgcgcgtttttactggaaagtctgggatatgacgtaaaatgctggacgcagggggcggattttttggcgcaggccagtctgtatcaggccggggtcgtattactggatatgcgaatgccggtactggatgggcagggcgttcatgatgcgttgcgccagtgcggaagtaccctggcggttgtttttcttaccgggcatggcgatgtaccgatggccgtggagcagatgaaacgcggcgccgtcgattttctgcaaaaaccggtatcggtaaaaccgctacaggcggcgctggagcgtgcgctgacggtttcatcggcagcggtggcgcgtcgtgagattatactgtgttaccagcagttgacgccgaaagagcgtgagctggccagcctggtggcaaaaggatttatgaaccgtgaaattgcggaagcgatgaatatcgcggtgcgtaccgtagaggtgcaccgcgccagagtcatggaaaaaatgcaggccggtagcctggcggaactgattaggcgtttcgaaaaaatggcctcgccagagaccagaatacgaacaacgtatgagccatgaataataaaccgcgttatttctttgatttgcatcaaattttgtttaatagagaagactgttatattctgttggtttgatctggcgacgagtaaaacgtatgacaaaaccgacaaaagatgacgaactgtaccgcgagatgtgccgggtggtgggcaaggtcgtgctggaaatgcgcgatctggggcaggagcctaaatatattgttattgcgggcgtgttaagaaccgcgctggcgaatcaacgcatccaacgtagcgcgttagaaaaacaggctatggaaaccgtgattaacgctctggcgcggtcatagccgctatcagggtggcaataacgacatcgcctttgaattgtcgcgattgtcaccatggcgggcgggttacccgccgttagcgatgcgcagggttatcaggtgatggctaagcgcagccctaatgtatcagggtacggctcaaaataattctggctgcgtagatagtcatccggatgttccgccagatagtgcttcagcagcgttaacggtgccaggataggtagtcggcccgcccggtagccgagaatcacctcgcgtaattccgcgcgttgcctgctgttcaacgcgcggtgaaaatagccctggatatgcatcagcacattggtgtgatttttacgtgaagcggggtggcgcaggatagccatcagtttttctctgtatcggacaaagaaggcatccagatcgtcccactcatgcagacgcgcgacgaaagggccaatttcgcggtagccggcctggtggtgggcgagaagctgaagtttgtatcggctatgaaacgcgagcaaactgtgacgactcaagccctgcgcgcgtagcgcatttaattcatgtagcgcgaagatacgtgcgatgaaattctcgcgtagtaccggatcgtgcaggcgaccatcttcctctatcggcagccagggatatttgtccatcatcgcggcggtaaacagccccgtgccagctttgcggcccctgttacccttttcatcatacaggcgaacgcgctccattccgcaactgggcgattttgcacacacaataaaccccgccagttcgcctattgttggcagaaaccgatcagcaaaggcattcattcgctcggtgacgtcatcgtgcggggcatggctatagcgcatccgaatgtcgccacaggtcgtctggataagacgcagcgcagggcggggcacgggcaggccgatcgccacctccgggcagatcggtttgtaggccacccacggcgccagagagttcatgacaaaatccatacgcttatgtccgccatcaaagcgtaccgtggcgccagtcagacatccgctaatgccgactacgggtttgttattcatgattcccccttattgaaagtacgacgactgacgccaatggcgcaaaatgttatctcacgctgatttaaaacttacacaactttgtttttttgtctaagttttcgcggagattttttttgacgtaattaaatatcaataagatagaatgaggggaagaaatctatttcagcgcctatagtgtgataacctccagcgaagcgaccacgttgcgccactgggcaagctgttttttctgcccggcagtgagctttccggtggtcaccaggaaccattttctctgggcgaacagctcgggcgccagcacaactgggggcgagggaagcacattgagccgcagctcttgtccggtacgagtcaacgtttccagccagatttcacagtgatccgagagattccatccgctaataaaggcattgttgccaggcgcttttctgtcgccttcaaggcaaaaagaggtgtaggcaataatgatgccatccagtatttcgcgcagcgtcatcacggcgggaagatgcgcggacactttgctgcgcaacggacgcaataaatgggtcaccagttctgcgcggggatattcccggccacagtcataaatcaactgccgcagcgcgtcaattcgcccttcgtggagatgttgaagcatcgtctcctggatcgttatccagttatcgcccaggcgaataaccggacgcgacagtaagggtttgacctggcttatcggtacgccttttctcacccagtcgagaatgctaagcgcttgtcgaatatcgtcatcgctgtataagcgatgtccgccatcagtacgctgcggtttcaataaaccatagcgtcgctgccatgcccttagcgtggcggcattgataccgcatagtctggcaaattcgccgatagaatacgacatggtaaagcccgttaaataaggggattctactatatcatgatcaaatgaagactaaggtagtgataaatggtgcggcataccagggcatccgtatggattttgtcgatgatgagcaatactgcgtggcgtaaggctcatcaaaatatgaccaatgcttaataccatcggacgcccctggttaatactctattaacctcattcttcgggcacagttaagtaactctgtcactttatgaacctgtagctttctcatcatattcatccggtgtgtttcgacggtttttatactgatatgtagcttttcgctgatcccatgattggtatacccctcgtcaataagtttaagaacctgacgctcgcgcaaagtaagcagttgatgattggtcgtgtcagcgtttaattcagccaggatagcttcccgattcaacgttgggtcaatgtaacgcttgtttactgctactgtttgcaatgccgctaacagaacttgctgactactgctttttaaaacatagccattagcacctgcggctaaagttttaatggtcatatactcttgttggtatgctgtgtaaaccagaatattcattgctggccaacgctgatgtaattgaggaatgatatccaggccattgatgccaggtagactaagatcaaggataagtatgtcaggctcgtatgcacaacaggcattataaacctcaagaccatttttaacatgctctacaattttaaaatgaggccagggtaataaggcattcataatgccgttaatgatgatttcatgatcgtctactaataagatcttatattctttcattttgctgccctcgcgaaaattaagataatattaagtaatggtgtagtttttgaagatcatacgtattttctggcgtaagtcggttagttcctccagcgcgatgattttccccatttttacgcgattctcaatgtctatgacatagcataccaattcagtctgccctatttgacctaaacagccttttaatgtgtgaattaactgatcgattttttctccagccgatacggcattttcaatatcagccagcaagaggtccagtgattggaaaatcttgctattaatgaccatatcatctgtcgccagtagcgctgagcagcgactcggatcctgctcctgtagctctatatttcgtaaaagttggtattctgcggcaatactgatgtagcgagctaaggtagccaatgtcactggttttgtaatgtaatgatgaatcccattttttttacaacgatgaatatcttctgtcgctacgctagcggatagtgccacaaacatgcagtcaggatctaaattattcggctcatcatgccataatcgtacacattcaataccatctatttctggcattctaatgtcaatcagtactaaatcgaatcgctgctgttgtgataaagtcagagcctcgttactactggcggcaatagtgacgtgttggcccaggctgacaagcattttgccgatgatatcccgattaatatcggcatcatcaaccaaaagaatctgcaactgccagggtggtaacaaattatttattactggcatatttggtgtacacaatattaactgttgcgccaggtcgtagagttttccggagaaatacaaaagctctgcgttgagaagcgcattttgctggtggggtggttcaccgcgtattccccagcaagccagttgccgatgcaggcagaacggcgctgacagcgtccctttaattggttgaggcggctggtattcttgtaagggtaatactagcgagacacaggttccaaccccggggacactttttagtgtcagattaccgcccatcattttagccaggcttgacgcaatagtcagtccaattcctgtaccttgcgaatttgtgtctgcttgataaaaagcagtaaagatttgagactgctgctgtatttcaatccctttaccgctatcgctaaccagaaatattaattgttcctcatgacgcttgaccgtcagacgtatccctccggtttcggtaaattttaccgcgttcccgagtaaattaaccaaaatttgccgtaaacggatactgtcggtatgaaaatagagagggacatgttgaccgacaaaagtacgtaatgacagttttttgctttgcgctggcccctggatggtttgcattgcctggtccagtaacggcagtaacgctgtttcttccatatgtaatgtgaaatgaccagactcgatgcgtgaaaaatccagcagattattaataatagctaacaaagacagtgtacaatttctggcggtatcagctaatccttgttgctctatgtttaaaggggtggtttgtaataattcaattgcaccgagtacgccattcatcggagtacgtaactcatgacttattaccgtaagatgaatgcttttacgtttgttagctcgctcagcgcgtttttttgcttcatttagcgcctgggtgcgctctgcgactttgttttccagattgtcgtattggacttgtagagtatcaagcagttggttaaaagcaccggcaatactatctaattcatccagtcgttgtgctggtaaacgtgtgctcagcggtgcagttgcggttttattaatgacatcgacaaaacgccataacggtttggccagtgagcgatgtagtaaccagcaaaaagccgacgtcatcaacaccaatgctgttaatgtaaaggggatttgttgaaggataatttttaagatgcgattatgtagattaccgtatgggtacagcgtaaccagactccatccggggccatgcaaggttgtgcgtaatatcagaaatccgggaatttgctgccatccatcatgcagcgttacattttctaactgtgtacgtattttttgcgggatgtatgaaaacggcaataagtggttgttttgatccagccatactcgaatactatcatctaatggcaggtggctcttagtaatgagatcgggaagtttaaccgtcacctcaaaaaatacgccttgctgatcggcaaccgcaacggaagcgtgccatcctttgccgtttatgtattctggttcactccagtaaaacccggcatgggttgggtataaaggaaagctttttcgcgttaaaggctgtagagttgaataatctgaagggttatcagtagataataacgaaatctcatttttatgattaagaataaaactatcgcgacgaaagctattttcatcgatatcagaggactgcagaaagagacggtgcttctctccgtttagcgtcggcgtgcaatttgaaggaccgacagatagatgccggctcacctcagggaaaatatcgttatgatgaatctcagtcgctaatgagcattgatacattaaatttttagcgtcacgttcagcttcttcaaaccgttgattgcttagtacaatattcatctcggatagaacggataaatcctctattatatgctgccgtttctgaaccattgatatataagctgcggtaagcacagatagcagccaaataattattgttgttaataaaaataaaaaagttagcctgattactaaagatgtttgcagcgtattcttgagattgagcaaattcataatgcttccctccagttgcctgttgcaaaatctttggcacttgatcactatcgcagtacatatagtttcatcagaagattaatcgatggtgttatcattaggaagataaatttcttcatatataacccagtcgatgactacaattactttttaataagatggcgatgtaaaaacatcgtaacagtttatttaataaataatttttcaaattgtaagtttttatgtcaatgctgaaaatgtaattgtgaatttatcggaaaatccgaatgatagaatcgcctgtgacaaggtatatgtagacagcatcctgatattgtacaagaagagtatagtcgaaataaatgtgaatcaggctttttacggatgtggttgtgagcgaatttgatagaaactcccatttatgtctgaggagggattcatgctggcagttttaaaaggcattccattaattcaggatatcagggccgaaggtaatagccgatcctggataatgactattgatgggcatcctgccagaggagaaattttctcagaagcattttctatttctttgttcttaaatgacctggaaagcttacctaagccttgtcttgcctatgtgacactactgcttgcagcacacccggacgtccatgattatgctatacagctcacagcggatgggggatggttaaacggttattataccacaagtagtagctctgagcttattgctattgagatagaaaaacacctggctttaacttgcattttaaaaaatgtaatacgcaatcaccataaactttattcgggtggggtataaaatggtagtaaataaacgtttaatcttaattttactatttatactcaatacagcaaagagtgatgagttatcatggaaaggtaatgacttcaccctttatgccagacaaatgccattagcagaggttttacatctgctctcagagaactatgatacggctattactattagcccattgataacagctacatttagtggaaaaattccgcctggaccaccggtcgatattttgaataacctggcagcacaatatgatttgcttacctggtttgatggcagcatgttatatgtatatcctgcatcgttattaaaacatcaggttatcactttcaatattttatctactggacggttcattcattacttacgcagccagaatatcctttcatcaccgggatgcgaggttaaagaaattaccggtaccaaagctgtggaggtgagcggtgttcccagctgcctgactcgtattagtcaattagcttcagtgctggataatgcgttaatcaaacgaaaagacagtgcggtgagtgtaagtatatacacgcttaagtatgccactgcgatggatacccagtaccaatatcgcgatcagtccgtcgtggttccaggggtcgttagtgtattgcgtgagatgagtaaaaccagcgtcccgacgtcatcgacgaacaatggttcacccgctacacaggcattgcccatgtttgctgccgacccacgccagaatgcagtgatcgttcgtgattatgcggccaatatggccgggtatcggaaactcatcacagaattagatcaacgccagcagatgatagagatttcggtgaaaattatcgatgttaatgctggagatattaaccagttaggcatcgactggggaacggcagtgtcgctgggtggcaagaaaattgcgttcaatacaggtttgaatgacggtggtgctagtggtttttcaacggtaatcagcgatacctcaaactttatggtgcgtctgaatgccctggaaaaaagctctcaggcttatgtactttcccagccatctgtggtgactttaaataatatccaggctgtgctggataaaaatattactttctataccaaactgcagggagaaaaagtggctaaacttgaatccatcactacgggttctttgttacgcgttacacctcgcttgttaaatgacaatggcacgcaaaaaataatgcttaatcttaatattcaggatggacaacaaagtgatacgcaaagcgaaacagacccgctgcccgaagtgcaaaattctgaaattgcttcgcaagccacattattggccgggcaaagtctattgctgggagggtttaaacaaggtaaacaaatccactcgcaaaacaaaatccctttattgggcgatattcctgttgtaggtcatttgtttcgcaatgatacgactcaagtacatagtgtaatcaggctttttttgattaaagcctcagtagtaaataatggcatatctcatggttaatccaaagagttcctggaaaatacgttttttaggtcacgttttacaaggccgggaagtatggctgaatgaaggtaacctgtcactgggggagaagggatgcgatatttgtattccgctggctataaatgaaaaaattattctgagagaacaggcagatagtttatttgttgatgccgggaaagccagagttagagttaatggccgcagatttaatccaaataagccgctaccatccagtggggttttgcaggttgcgggagtggctatcgcgtttggtaaacaggattgtgaacttgctgattatcaaatacccgtttccagatcagggtactggtggttggctggcgtattcttgattttcatcggtggaatgggtgtcctgttaagtattagtggtcagcctgaaacggtaaatgacttacctttgcgggttaagtttttattagacaaaagcaatattcattatgtgcgggcgcaatggaaagaagatggcagcctgcagttgtccggttattgctcgtcaagcgaacagatgcaaaaggtgagagcgactctcgaatcatggggggtcatgtatcgggatggtgtaatctgtgatgacttattggtacgagaagtgcaggatgttttgataaaaatgggttacccgcatgctgaagtatccagcgaagggccggggagcgtgttaattcatgatgatatacaaatggatcagcaatggcgcaaggttcaaccattacttgcagatattcccgggttattgcactggcagattagtcactctcatcagtctcagggggatgatattatttctgcgataatagagaacggtttagtggggcttgtcaatgttacgccaatgcggcgctcttttgttatcagtggtgtactggatgaatctcatcaacgcattttgcaagaaacgttagcagcattaaagaaaaaggatcccgctctttctttaatttatcaggatattgcgccttcccatgatgaaagcaagtatctgcctgcgccagtggctggctttgtacagagtcgccatggtaattacttattactgacgaataaagagcgtttacgtgtaggggcattgttacccaatgggggagaaattgtccatctgagtgccgatgtggtaacgattaaacattatgatactttgattaactatccattagattttaagtgagtggaaaatgacaactttgacccggttagaagatttgctgcttcattcgcgtgaagaggccaaaggcataattttacaattaagggctgcccggaaacagttagaagagaacaacggcaagttacaggatccgcagcaatatcagcaaaacaccttattgcttgaagcgatcgagcaggccgaaaatatcatcaacattatttattatcgttaccataacagcgcacttgtagtgagtgagcaagagtaaagtaaaaatatcttagagcctatcccaccaggcgttaattggcgcagccagtttggacacggatagcgcgcaaaaaccgcagcgtacacgtagtacgtgaggtttgactcgctacgctcgcccttcgggccgccgctagcggcgttcaaaacgctaacgcgttttggcgagcactgcccaggttcaaaatggcaagtaaaatagccctaatgggataggctcttagttagcacgttaattatctatcgtgtatatggaggggaatgatgataaagaaaaaggctgcgtttagtgaatatcgtgatttagagcaaagttacatgcagctaaatcactgtcttaaaaaatttcaccaaatccgggctaaggtgagtcaacagcttgctgaaagggcagagagccccaaaaatagcagagagacagagagtattcttcataacctatttccacaaggcgttgccggggttaaccaggaggccgagaaggatttaaagaaaatagtaagtttgtttaaacaacttgaagtacgactgaaacaacttaatgctcaagccccggtggagataccgtcaggaaaaacaaaaaggtaaagcataatgtcttcaggaaacatcttatggggaagtcaaaaccctattgtgtttaaaaatagcttcggcgtcagcaacgctgataccgggagccaggatgacttatcccagcaaaatccgtttgccgaagggtatggtgttttgcttattctccttatggttattcaggctatcgcaaataataaatttattgaagtccagaagaacgctgaacgtgccagaaatacccaggaaaagtcaaatgagatggatgaggtgattgctaaagcagccaaaggggatgctaaaaccaaagaggaggtgcctgaggatgtaattaaatacatgcgtgataatggtattctcatcgatggtatgaccattgatgattatatggctaaatatggcgatcatgggaagctggataaaggtggcctacaggcgatcaaagcggctttggataatgacgccaaccggaataccgatcttatgagtcaggggcagataacaattcaaaaaatgtctcaggagcttaacgctgtccttacccaactgacagggcttatcagtaagtggggggaaatttccagtatgatagcgcagaaaacgtactcatgaaaaaagacccgaccctacaacaggcacatgacacgatgcggtttttccggcgtggcggctcgctgcgtatgttgttggatgacgatgttacacagccgcttaatactctgtatcgctatgccacgcagcttatggaggtaaaagaattcgccggcgcagcgcgactttttcaattgctgacgatatatgatgcctggtcatttgactactggtttcggttaggggaatgctgccaggctcaaaaacattggggggaagcgatatacgcttatggacgcgcggcacaaattaagattgatgcgccgcaggcgccatgggccgcagcggaatgctatctcgcgtgtgataacgtctgttatgcaatcaaagcgttaaaggccgtggtgcgtatttgcggcgaggtcagtgaacatcaaattctccgacagcgtgcagaaaagatgttacagcaactttctgacaggagctaaaaatgaatcgaattcacagtaatagcgacagcgccgcaggagtaaccgccttaacacatcatcacttaagcaatgtcagttgcgtttcctcgggttcgctgggaaagcgccagcatcgtgtgaattctacttttggcgatggcaacgccgcgtgtctgctatccgggaaaattagtcttcaggaggcaagcaatgcgttgaagcaactgcttgatgccgtacccggaaatcataagcgtccatcattgcctgactttttgcagaccaatcccgcggttttatcaatgatgatgacgtcattaatactcaacgtctttggtaataacgctcaatcgttatgccaacagcttgagcgggcaactgaggtgcaaaatgcattacgtaataagcaggtaaaggagtatcaggagcagatccagaaagcgatagagcaggaggataaagcgcgtaaagcgggtatttttggcgctatttttgactggattaccggcatatttgaaaccgtgattggcgccttaaaagttgtggaaggttttctgtccggaaatcccgcagaaatggctagcggcgtagcttatatggccgcaggttgtgcaggaatggttaaagccggagccgaaacggcaatgatgtgcggtgctgaccacgatacctgtcaggcaattattgacgtgacaagtaagattcaatttggttgtgaagccgtcgcgctggcactggatgttttccagattggccgtgcttttatggcgacgagaggtttatctggcgcagctgcaaaagtgcttgactccggttttggcgaggaagtggttgagcgtatggtaggtgcaggggaagcagaaatagaggagttggctgaaaagtttggcgaagaagtgagcgaaagtttttccaaacaatttgagccgcttgaacgtgaaatggctatggcgaatgagatggcagaggaggctgccgagttttctcgtaacgtagaaaataatatgacgcgaagcgcgggaaaaagctttacgaaagagggggtgaaagccatggcaaaagaagcggcaaaagaagccctggaaaaatgtgtgcaagaaggtggaaagttcctgttaaaaaaattccgtaataaagttctcttcaatatgttcaaaaaaatcctgtatgccttactgagggattgttcatttaaaggcttacaggctatcagatgtgcaaccgagggcgccagtcagatgaatactggcatggttaacacagaaaaagcgaagatcgaaaagaaaatagagcaattaataactcagcaacggtttctggatttcataatgcaacaaacagaaaaccagaaaaagatagaacaaaaacgcttagaggagctttataaggggagcggtgccgcgcttagagatgtattagataccattgatcactatagtagcgttcaggcgagaatagctggctatcgcgcttaatctgaggataaaaatatggaagcgagtaacgtagcactggtattaccagcgccttccttgttaacaccttcttccactccatctccctccggggagggaatgggtactgaatcaatgcttctgttatttgatgatatctggatgaagctaatggagcttgccaaaaagctgcgcgatatcatgcgcagctataacgtagaaaaacaacggctggcctgggaactgcaagtcaatgttttacagacgcaaatgaaaacaattgatgaagcgtttagagcatcaatgattactgcgggtggcgcaatgttgtcgggtgtactgacgataggattaggggccgtaggcggggaaaccggtcttatagcgggtcaagccgtaggccacacagctgggggcgtcatgggcctgggggctggtgtagcgcaacgtcaaagtgatcaagataaagcgattgccgacctgcaacaaaatggggcccaatcttataataaatccctgacggaaattatggagaaagcaactgaaattatgcagcaaatcatcggcgtggggtcgtcactggtcacggttcttgctgaaatactccgggcattaacgaggtaaacatggtgcaagaaatagagcaatggttacgtcggcatcaggtgtttactgagcctgcatatttaggggagaccgccatattacttgggcagcagtttatattatcgccttacctggtgatctatcgtattgaggcaaaagaaatgattatttgtgagttcaggcgcctgacgcccgggcaacctcgaccacagcaattgtttcacttactgggacttttacgcgggatatttgtgcatcacccgcagttaacatgtttaaagatgttgataatcaccgacgttctggatgaaaaaaaagccatgctacgcaggaaattattgcgcatcctgacagtaatgggagcgacctttacacagcttgatggcgataactggacagttttatccgccgagcatcttatccagcgacgtttttaaatgaccttcctgacgtaaatcattatcacgtgaaaataacaatcaataggtatgatgatgaaagaagatcagaaaaataaaatacccgaagacattctgaaacagctattatccgttgatccggaaaccgtttatgccagtggttacgcctcatggcaggagggggattattcgcgcgccgtaatcgattttagttggctggtgatggcccagccatggagttggcgtgcccatattgcattggctggcacctggatgatgcttaaagaatacacgacggccattaatttctatggacatgccttgatgctggatgccagccatccagaaccggtttaccaaacgggcgtctgtctcaaaatgatgggggaacccgggttggcgagagaggcttttcaaaccgcaatcaagatgagttatgcggatgcctcatggagtgagattcgccagaatgcgcaaataatggttgatactcttattgcttaaataacagaacgaaatatgaaaattcatattccgtcagcggcaagtaatatagtcgatggtaatagtcctccttccgatatacaagcgaaggaggtatcgtttcctccccctgaaattccagcgcctggcacccccgcagcccctgtgctgcttacgcctgaacaaataaggcagcagagggattatgcgatacattttatgcaatacactattcgtgcgctgggtgcgacagtcgtgtttgggttatcggttgctgcagcggtaatttctggcggggcaggattacccattgctattcttgcgggggcggcgctcgtgattgctattggggatgcttgctgtgcgtatcataattatcaatcgatatgtcagcaaaaggagccattacaaaccgccagtgatagcgttgctcttgtggtcagtgcgctggccttaaaatgtggggcaagtcttaactgcgctaacacccttgctaattgtctttctttattaatacgttcaggaatcgctatttctatgttggttttacccctacagtttccactgcccgcggctgaaaatattgcggcctctttggacatggggagtgtaattacctccgttagcctgacggcgataggtgcggtactggattattgccttgcccgcccctctggcgacgatcaggaaaattctgttgatgaacttcatgccgatcccagtgtgttattggcggaacaaatggcagcgctctgtcaatctgctactacacctgcattaatggacagttctgatcatacatctcggggagaaccatgaaacctgttagcccaaatgctcaggtaggagggcaacgtcctgttaacgcgcctgaggaatcacctccatgtccttcattgccacatccggaaaccaatatggagagtggtagaataggacctcaacaaggaaaagagcgggtattggccggacttgcgaaacgagtgatagagtgttttccaaaagaaatttttagttggcaaacggttattttgggcggacagattttatgctgttccgctggaatagcattaacagtgctaagtggtggaggcgcgccgctcgtagccctggcagggattggccttgctattgccatcgcggatgtcgcctgtcttatctaccatcataaacatcatttgcctatggctcacgacagtataggcaatgccgttttttatattgctaattgtttcgccaatcaacgcaaaagtatggcgattgctaaagccgtctccctgggcggtagattagccttaaccgcgacggtaatgactcattcatactggagtggtagtttgggactacagcctcatttattagagcgtcttaatgatattacctatggactaatgagttttactcgcttcggtatggatgggatggcaatgaccggtatgcaggtcagcagcccattatatcgtttgctggctcaggtaacgccagaacaacgtgcgccggagtaatcgttttcaggtatataccggatgttcattgctttctaaattttgctatgttgccagtatccttacgatgtatttattttaaggaaaagcattatggatattgcacaattagtggatatgctctcccacatggcgcaccaggcaggccaggccattaatgacaaaatgaatggtaatgatttgctcaacccagaatcgatgattaaagcgcaatttgccttacagcagtattctacatttattaattacgaaagttcactgatcaaaatgatcaaggatatgcttagtggaatcattgctaaaatctgaagttattagcgacgatgttcgacggttgctgctggaaatcatgtttgcgggcgttaaccatagcctgatttcccaggtacatgcgatgttaccagcgctaacggttattgttccggataaaaaattacagttggtatgtctggcattattgttggcgggtttaaatgagccgctaaaagccgcgaaaattttatcggatatagatttgccagaggctatggcgctgcgtctgttatttcctgcaccaaatgaggggtttgaaaattgaatatttctgatatgagcgtagtgcctgtaagcactcaatcttatgtaaagtcctctgcagaaccgagccaggagcaaattaatttttttgaacaattgctgaaagatgaagcatccaccagtaacgccagtgctttattaccgcaggttatgttgaccagacaaatggattatatgcagttaacggtaggcgtcgattatcttgccagaatatcaggcgcagcatcgcaagcgcttaataagctggataacatggcatgaaggttcatcgtatagtatttcttactgtccttacgttctttcttacggcatgtgatgtggatctttatcgctcattgccagaagatgaagcgaatcaaatgctggcattacttatgcagcatcatattgatgcggaaaaaaaacaggaagaggatggtgtaaccttacgtgtcgagcagtcgcagtttattaatgcggttgagctacttagacttaacggttatccgcataggcagtttacaacggcggataagatgtttccggctaatcagttagtggtatcaccccaggaagaacagcagaagattaattttttaaaagaacaaagaattgaaggaatgctgagtcagatggagggcgtgattaatgcaaaagtgaccattgcgctaccgacttatgatgagggaagtaacgcttctccgagctcagttgccgtatttataaaatattcacctcaggtcaatatggaggcctttcgggtaaaaattaaagatttaatagagatgtcaatccctgggttgcaatacagtaagattagtatcttgatgcagcctgctgaattcagaatggtagctgacgtacccgcgagacaaacattctggattatggacgttatcaacgccaataaagggaaggtggtgaagtggttgatgaaatacccttatccgttgatgttatcgttgacaggactgttattaggagtgggcatcctgatcggctatttttgcctgagacgccgtttttgagccgacctgatcccgaggtgttgcaactttatcgttatttctggcaacctgctcgttacgctgtaccggaatggctggataagctgggctttcatctttcaaactgctggcgttatggcgatcggcccgagttggatcgtcttcttgacagagcgttaaatagactaagaggaagctctgttattccagcctgtttaaatgacaggcaaaaacggcaggttcgtcttgcgccgcgtatatcggcatttgcctttgggctgggattattcaaactcaggtgtagtgactattttatgctaccagagtatcggcaattgcttctacagtggtttagcgaggatgagatctggcagctatatggttggttggggcaaagagatggcaaattacttcctccgcaagtgatgcaacaaactgcattgcagatcggtaccgccattcttaatcgggaagcgcatgacgatgcggttttacatgcgctattagtattattaccccctccgcagcgtatactttggccgaagacttctcttaccgagattatcttcatggagcatttgctatgagttttacttcacttcctctgacggaaattaaccataagctacccgctcgaaatattattgagtcacagtggataacattacaattaactttatttgcgcaagagcaacaagctaagagagtttcacatgctattgtgagctccgcttaccgtaaggctgaaaaaatcatccgagacgcctatcgttatcagcgtgaacagaaagttgagcagcaacaagaactagcgtgcttgcgtaaaaatacgctggaaaaaatggaagtggaatggctggaacagcatgtaaaacatttacaagacgatgaaaatcaatttcgttcattggtcgatcacgcagcgcatcatattaaaaatagtatagaacaggttctgttggcctggttcgaccaacagtcggtagacagtgttatgtgccatcgtctggcacgccaggccacggctatggcggaagagggagcgctttatttgcgtattcatcctgaaaaagaggcattgatgcgagaaacttttggcaagcggtttacgttgattatcgagcctggtttctctcccgatcaggctgaactttcctcaacacgatatgccgttgaattttcactttctcgtcatttcaacgcgttactgaaatggttacgtaatggtgaagataaaagaggtagcgatgaatattaaaattaatgagataaaaatgacgccccctacagcatttacccctggccaggttatagaggaacaagaggttatttcgccttcaatgttagctctccaggagttacaggaaacgacgggggcagcgctctatgagacgatggaagaaataggaatggcgctgagtggtaaactgcgcgaaaattataaattcactgatgctgagaaactggagcgcagacagcaggctttgctgcgtttgataaaacaaatacaggaggataatggggcaacgttgcgtccgcttaccgaagagaatagtgatcctgatttacagaatgcgtatcaaattatcgctcttgcaatggcgcttactgccggcgggttgtcaaaaaagaaaaaacgcgatttgcaatcgcaactggatacgcttacagcggaggagggatgggaacttgccgtttttagtttactggaacttggcgaagtggataccgctacgctgtcctctctgaagcgttttatgcaacaggcgatagacaacgatgaaatgcccttatcgcagtggttcagacgcgtggcagactggccggatcgctgtgaacgggtccgtattttgctaagagcagtagcctttgaacttagcatatgcatcgaaccctcggagcaaagtcgtttggccgcagcattagtacgtttgcgtcgtttgctgttattccttggccttgaaaaagagtgccagcgtgaggagtggatttgccagttgccgcctaatacattactgccgctactactcgatattatttgtgagcgctggcttttcagtgattggttgcttgatagacttaccgctatagtttcttcatcgaagatgttcaatcggttactccaacaacttgatgcgcagtttatgctgatacccgataactgttttaacgacgaagatcaacgtgaacaaattctcgaaacgcttcgtgaagtaaagataaatcaggttttattctgatacctggctttcaatatttaggtaaattggctttctggctcatcatgaggcgtcaggatggattgggatctcattactgaacgtaatattcagctttttattcaattagcaggattagctgaacggcctttagcaaccaatatgttctggcggcaaggacaatatgaaacctatctaaactatcataacggtcgtattcacttatgtcagatactcaagcaaaccttcttagacgaagaactgctttttaaagcgttggctaactggaaacccgcagcgttccagggtattcctcaacgattatttttgttgcgcgatgggcttgcaatgagttgttctccacctctttccagctccgccgagctctggttacgattacatcatcgacaaataaaatttctggagtcgcaatgcgttcatggttaggtgagggagtcagggcgcaacagtggctcagtgtatgcgcgggtcggcaggatatggttctggcgacggtgttattaatcgctattgtgatgatgctgttacctttgccgacctggatggttgatatcctgattactatcaaccttatgttttcagtgatcctgctcttaattgctatttatcttagtgaccctctcgatttatcggtatttccgtctttattacttattactacattatatcgtttgtcactcacaatcagcacatcacggctggtactgttacaacataatgccggtaatattgtggatgctttcggtaagtttgtcgtaggaggaaatctcaccgttgggttggtcgtatttaccatcattactatcgtgcaatttattgtcattacaaaaggtatcgagagggtggcggaagttagcgcacgtttctcgcttgatgggatgccaggcaaacaaatgagtatcgatggcgatttgcgtgccggagttatcgatgcagaccatgcccgtacattaagacagcatgtccagcaggaaagccgctttctcggtgcgatggacggtgcgatgaaatttgttaaaggcgatacgattgccggtattattgttgttctggtgaacattatcggcggtatcattatcgctatcgtacaatatgatatgtcgatgagtgaggctgttcacacttatagcgtactgtcaatcggagatggtttatgtgggcaaattccatcgctgctgatttcccttagcgcgggaattattgtcacccgtgtcccgggtgagaaacgccagaacctggcgacagagttgagttctcaaattgccagacaacctcagtcgctcatattaaccgctgtggttttaatgctcctcgctttaattcctggctttccttttatcactctcgctttcttttcagcgttgttagcattgccaattatcctcattcgccgcaaaaagtctgtggtttccgcaaatggcgtcgaagcaccggaaaaagatagtatggttcccggcgcatgtcctctaatcttacgtcttagcccgacgttacattctgccgacctgattcgtgatattgacgccatgagatggtttttatttgaggataccggcgtccctctccctgaggtgaatattgaggttttgcctgaacccaccgaaaaattgacggtactgctatatcaggaacccgtatttagtttatctattcccgctcaggcggattatttattgataggcgcggacgctagtgtggtgggtgacagccagacgttaccgaacgggatggggcagatctgttggcttacaaaagacatggcccataaggcgcaaggttttggactggacgttttcgcgggcagccaacgtatctctgccttattaaaatgtgtcctgcttcggcatatgggagagtttattggtgttcaggaaacgcgttatctaatgaatgcgatggaaaaaaactactctgagctggtgaaagagcttcagcgccagttacccattaataaaatcgctgaaactttgcaacggcttgtatcagagcgggtttctattagagatttacgtcttattttcggcaccttaattgactgggcgccacgtgaaaaagatgtcctgatgttgacagaatatgtccgtatcgcgcttcgtcgtcatattctgcgtcgtcttaatccggaaggaaaaccgctgccgattttgcggatcggcgaaggtattgaaaacctcgtgcgtgaatccattcgccagacggcaatggggacctatactgcgctgtcgtctcgtcataagacgcagatcctgcaacttatcgagcaggcgctgaagcagtcagccaaattattcattgtcacttctgtcgacacccgacgtttcttgcgaaaaattacagaagccaccttgttcgacgtaccgattttgtcatggcaggaattaggagaggagagccttatacaagtggtagaaagtattgaccttagcgaagaggagttggcggacaatgaagaatgaattgatgcaacgtctgaggctgaaatatccgccccccgatggttattgtcgatggggccgaattcaggatgtcagcgcaacgttgttaaatgcgtggttgcctggggtatttatgggcgagttgtgctgtataaagcctggagaagaacttgctgaagtcgtggggattaatggcagcaaagctttgctatctccttttacgagtacaatcgggcttcactgcgggcagcaagtgatggccttaaggcgacgccatcaggttcccgtgggcgaagcgttattagggcgagttattgatggctttggtcgtccccttgatggccgcgaactgcccgacgtctgctggaaagactatgatgcaatgcctcctcccgcaatggttcgacagcctatcactcaaccattaatgacggggattcgcgctattgatagcgttgcgacctgtggcgaagggcaacgagtgggtattttttctgctcctggcgtggggaaaagcacgcttctggcgatgctgtgtaatgcgccagacgcagacagcaatgttctggtgttaattggtgaacgtggacgagaagtccgcgaattcatcgattttacactgtctgaagagacccgaaaacgttgtgtcattgttgtcgcaacctctgacagacccgccttagagcgcgtgagggcgctgtttgtggccaccacgatagcagaattttttcgcgataatggaaagcgagtcgtcttgcttgccgactcactgacgcgttatgccagggccgcacgggaaatcgctctggccgccggagagaccgcggtttctggagaatatccgccaggcgtatttagtgcattgccacgacttttagaacgtacgggaatgggagaaaaaggcagtattaccgcattttatacggtactggtggaaggcgatgatatgaatgagccgttggcggatgaagtccgttcactgcttgatggacatattgtactatcccgacggcttgcagagagggggcattatcctgccattgacgtgttggcaacgctcagccgcgtttttccagtcgttaccagccatgagcatcgtcaactggcggcgatattgcgacggtgcctggcgctttaccaggaggttgaactgttaatacgcattggggaataccagcgaggagttgatacagatactgacaaagccattgatacctatccggatatttgcacatttttgcgacaaagtaaggatgaagtatgcggacccgagctacttatagaaaaattacaccaaatactcaccgagtgatcatggaaactttgctggagataatcgcgcggcgtgaaaagcaattacgcggcaagcttaccgtacttgatcagcagcaacaggcgattattacggaacagcagatttgccagacgcgcgctttagcagtgtctaccagactgaaagaattaatgggctggcaaggtacgttatcttgtcatttattgttggataagaaacaacaaatggccgggttattcactcaggcgcagagctttttgacgcaacggcagcagttagagaatcagtatcagcagcttgtctcccggcgaagcgaattacagaagaattttaatgcgcttatgaaaaagaaagaaaaaattactatggtattaagcgatgcgtattaccaaagttgagggaagtcttgggttgccatgccagtcttatcaggatgataacgaggcggaggcggaacgtatggactttgaacaactcatgcaccaggcattacccattggtgagaataatcctcctgcagcattgaataagaacgtggttttcacgcaacgttatcgtgttagtggcggttatcttgacggtgtagagtgtgaagtatgtgaatcaggggggctaatccagttaagaatcaatgtccctcatcatgaaatttaccgttcgatgaaagcgctaaagcagtggctggagtctcagttgctgcatatggggtatataatttccctggagatattctatgttaagaatagcgaatgaagagcgtccgtgggtggagatacttccaacgcaaggcgctaccattggtgagctgacattgagtatgcaacaatatccagtacagcaagggacattatttaccataaattatcataatgagctgggtagggtgtggattgcagaacaatgctggcagcgctggtgtgaagggctaattggcaccgctaatcgatcggctatcgatcctgaattgctatatggaatagctgaatgggggctggcgccgttattgcaagccagtgatgcaaccctctgtcagaacgagccgccaacatcctgcagtaatctaccacatcagctagcgttgcatattaaatggacagttgaagagcatgagttccatagcattatttttacatggccaacgggttttttgcgcaatatagtcggagagctttctgctgagcgacaacagatttatcctgcccctcctgtggtagtccctgtatattcaggctggtgccagcttacattaatcgaacttgagtctatcgaaatcggcatgggcgttcggattcattgcttcggcgacatcagactcggtttttttgctattcaactacctgggggaatctacgcaagggtgttgctgacagaggataacacgatgaaatttgacgaattagtccaggatatcgaaacgctacttgcgtcagggagcccaatgtcaaagagtgacggaacgtcttcagtcgaacttgagcagataccacaacaggtgctctttgaggtcggacgtgcgagtctggaaattggacaattacgacaacttaaaacgggggacgttttgcctgtaggtggatgttttgcgccagaggtgacgataagagtaaatgaccgtattattgggcaaggtgagttgattgcctgtggcaatgaatttatggtgcgtattacacgttggtatctttgcaaaaatacagcgtaaacctgataagaaaaataatatgcgaacaatataatagcgttccaggtcgtgtcatgagagatacagtatgtctttacccgattcgcctttgcaactgattggtatattgtttctgctttcaatactgcctctcattatcgtcatgggaacttctttccttaaactggcggtggtattttcgattttacgaaatgctctgggtattcaacaagtccccccaaatatcgcactgtatggccttgcgcttgtactttccttattcattatggggccgacgctattagctgtaaaagagcgctggcatccggttcaggtcgctggcgctcctttctggacgtctgagtgggacagtaaagcattagcgccttatcgacagtttttgcaaaaaaactctgaagagaaggaagccaattattttcggaatttgataaaacgaacctggcctgaagacataaaaagaaagataaaacctgattctttgctcatattaattccggcatttacggtgagtcagttaacgcaggcatttcggattggattacttatttatcttccctttctggctattgacctgcttatttcaaatatactgctggctatggggatgatgatggtgtcgccgatgaccatttcattaccgtttaagctgctaatatttttactggcaggcggttgggatctgacactggcgcaattggtacagagcttttcatgaatgattctgaattgacgcaatttgtaacgcaacttttatggatcgtcctttttacgtctatgccggtagtgttggtggcatcggtagttggtgtcatcgtaagccttgttcaggccttgactcaaatacaggaccaaacgctacagttcatgattaaattattggcaattgcaataaccttaatggtcagctacccatggcttagcggtatcctgttgaattatacccggcagataatgttacgaattggagagcatggttgaatggcacaacaggtaaatgagtggcttattgcattggctgtggcttttattcgaccattgagcctttctttattacttcccttattaaaaagtggcagtttaggggccgcacttttacgtaatggcgtgcttatgtcacttacctttccgatattaccaatcatttaccagcagaagattatgatgcatattggtaaagattacagttggttagggttagtcactggagaggtgattattggtttttcaattgggttttgtgcggcggttcccttttgggccgttgatatggcggggtttctgcttgatactttacgtggcgcgacaatgggtacgatattcaattctacaatagaagctgaaacctcactttttggcttgcttttcagccagttcttgtgtgttattttctttataagcggcggcatggagtttatattaaacattctgtatgagtcatatcaatatttaccaccagggcgtactttattatttgaccagcaatttttaaaatatatccaggcagagtggagaacgctttatcaattatgtatcagcttctctcttcctgccataatatgtatggtattagccgatctggctttaggtcttttaaatcggtcggcacaacaattgaatgtgtttttcttctcaatgccgctcaaaagtatattggttctactgacgctcctgatctcattcccttatgctcttcatcactatttggttgaaagcgataaattttatatttatctaaaagactggtttccatctgtatgagcgagaaaacagaacagcctacagaaaagaaattacgtgatggccgtaaggaagggcaggttgtcaaaagtattgaaataacatcattatttcagctgattgcgctttatttgtattttcatttctttactgaaaagatgattttgatactgattgagtcaataactttcacattacaattagtaaataaaccattttcttatgcattaacgcaattgagtcatgctttaatagagtcactgacttctgcactgctgtttctgggcgctggggtaatagttgctactgtgggtagcgtgtttcttcaggtgggggtggttattgccagcaaggccattggttttaaaagcgagcatataaatccggtaagtaattttaagcagatattctctttacatagcgtagtagaattatgtaaatccagcctaaaagttatcatgctatctcttatctttgcctttttcttttattattatgccagtacttttcgggcgctaccgtactgtgggttagcctgtggcgtgcttgtggtttcttctttaataaaatggttatgggtaggggtgatggttttttatatcgtcgttggcatactggactattcttttcaatattataagattagaaaagatctaaaaatgagtaaagatgacgtaaaacaggagcataaagatctggagggcgaccctcaaatgaagacgcggcgtcgggaaatgcagagtgaaatacaaagtgggagtttagctcaatctgttaaacaatctgttgcggtagtgcgtaatccaacgcatattgcggtttgtcttggctatcatcccaccgatatgccaataccacgcgtcctggaaaaaggcagtgatgctcaagctaactatattgttaacatcgctgaacgcaactgcatccccgttgttgaaaatgttgagctggcccgctcattattttttgaagtggaacgcggagataaaattcctgaaacgttatttgaacccgttgcagccttgttacgtatggtgatgaagatagattatgcgcattctaccgaaacaccataaatgcttttggtatgcttcttcaggccactgcgaaggttaagagggtaatagcgtatagagcagtgcttgacgataaaggtgagagactgaaaataatcgcttttagcctggcacaagcaccagatagcgtattataaaattaaacaagataatggattggtgcgtctgaatggactcgaaccatcgacccccaccatgtcaaggtggtgctctaaccaactgagctacagacgcattaaaatgatggtgcgttcaattggactcgaaccaacgacccccaccatgtcaaggtggtgctctaaccaactgagctatgaacgcaacgttgtaggtgacaacggggacgaatattagcgtcacaaccgcaatgaggcaagagggaaatcgcaattttcttcctgaaatcacctgattgcggtggaaatatgcaacatgtcgagaaaatagccgccatgcgacggctatcgtcgtattatcgcgcagcgcgctgcaaaatgatggcggacggctgacgttgtagatagcgcatccgtagcatcattaacaccgccgccgaggtcaggccgatgatgaaccccatccagaagcctgccggtcccatacgatccaccaccaaatccgttaacgccaggatataaccgctgggtaaacctaacacccagtaggcggtaaaggtgataaaaaagatggaacgcgtatctttataaccgcgcagaataccgctgccgataacctgtatagagtcggaaatctggtaaaccgcagcgagcagcattaattgcgcggcaagcgccacgacctcagggttgtcattgtagagcaaagcaatatgcttacgcagagtaacggtaaaaatagcggtaaccacagccatacaaatgccgacgcctaaaccggtacgcgctgcggtttgcgcatccagcgttgagccctggcccagacgataacccactcgaatcgttaccgccgcagccagcgacatcggcagtacgaacatcagcgagctaaagttaagcgcaatctgatgaccggcgacatccacaatacctaatggcgaaaccagcagcgcaacgaccgcaaataacgtcacttcaaagaacagcgccagcgcaatcggcaaccccagttgaatcaggcgcttcatgacgacgctatcgggtttgccaaagcctttttcattacgaatatcacgcattgaacgcgcgtgtttaatgtaagaaagcatggcgataaacatcacccaatagaccgccgcagtcgcaacgccgcagccgataccgccgagttccggcataccaaaatggccatagataaaaatatagttcaccggaatattcaccagcaggcccaaaaatcccatcaccatacccggtttggttttggccagaccttcgcactggtttcgcgctacctgaaagaaaaggtatcctggcgcgccccacagcagcgcgcgaagataacccacggctttatcggccagcgccggatcaatattatgcatagagcggataatgtatccggcattccacaggacgatcatcaccagcacggagacaaagcccgccagccagaacccttgtcgaacctgatgcgcgatacgctcacgacggccggagccattgagttgcgcaatcacaggcgtcaaggccagcagtaagccgtgaccaaacaaaatggcgggaagccagatagaggtgccgatagcgacggcagccatgtccgtagcgctatagcctcccgccatgacggtatcgacgaatcccattgcggtctgtgccacttgcgcaaggatcaccggtattgctaacgctaataactgacgcgcttcactggtatacttctgcacgtattcaccttttattttgttgttatatgaaagactaaaaagccgccgaagtggcagccaaaagaaatagcaggggaaatttcagtctattgtagcggggtattactatttctccagtgaaaaaacagttgttaacggcgcattgctggcaagctgtttttccacctgctattgtgctgaacagttctgcttttatttatttcaggagttgaagatatgtttacggggatcgtacagggtaccgcgaaactggtatcgattgatgaaaaacccaactttcgcacccatgtggtgacgttacctgactacatgctggaggggctggagacgggggcgtcggtagcgcataacggatgctgtttgacggtgactgaaataaacggtaaccagataagttttgatctgatgaaagaaacgttgcgcatcaccaatctgggcgcgttgagggtaggtgatgaggtcaacgtagagcgcgccgccaaattcagcgatgaaatcggtggtcatctgatgtcggggcatattattacgacggcggagatcgcgaaaatcctgacctccgaaaataaccatcaggtgtggtttaaagtgcaggatgcgtccctgatgaagtatatcctgtacaaaggctttatcggcgtcgacggcatcagtttgaccgtcggcgaggtaacgccaacgcgcttctgcgtgcatctcattccggaaacgttggaacgtactacgcttggcagaaaaaaactgggtgagcgtgtgaatatcgagatcgatccgcaaacgcaggcggttgtcgataccgtagaacgcgtactggctgcgcgagaaaatgcggtcagaaatcaggccgacattggctaacggaaaataagattcccccgcatgaaatgcgggggagatgattagcgaggaacgcgcagtccgttttcaacgccgcgcgtaaataccacctgccaaagctggatatcacgcgcgcgaaacgcacccgcgcaggcgttgagataatagctgaacatacgtttaaagcgctcgttataattgcccgcaatctctggccaggcattgataaagcgctcatgccacgccatcagagtcgtgtcatagtcggcgccaaagttatgccagtcttccattacaaagtgtgattcgctggcctcggcgatttgacgaacagacggcaaacaaccgttggggaaaatatacttattgatccacggatcgacattatgatcggtttttttagaaccaatagtatggagcaggaaaagaccatccggttttaaattcctgtcaacgacctcaaaataggtgttgtagttttttggcccgacatgttcgaacatgccgacagagacgattcggtcaaactgatcgttaaggtcgcgataatcttcgaggagaatggagacatccagaccttcgcaacgcgtctgcgccattttttgttgttcagcggagatcgttacgcccaccacgctaacgccataatgggtcgccatatattgcgacaggccgccccagccgcagccgatatccagcacacgcatccccggttgtagctgtagcttttcgcaaattaatttcagcttggcttgctgtgccgcttccagcgtatcggcatctttccagtaggcgcaagaatattgcatatagggatcgagcatacgggaaaaaaggtcattaccaagatcgtaatgttccttgccgacaatccaggcgcgttttttactttgtagattaatcagacgcgcgccgaggatacggagcgtatctttaacatggtgggggagttgattttcaagaccggcacgtaagactttgctgaagaaaatatccagacgctcgcattcccaccagccatccatgtaactctcacctaaccccaacgatccttcctgaaggacgcgtttaaaaaaatcgggattcttaacacgaatgtcagacggggcggaaccattaattgtaatatccgcgcgacttaacaattcgttggcgattcggtaccagttatcatccggtacgctgacttcttctatacacgatgaactcatagtttctccatcactggacggtgatcagaaccttaaaacagcgtagacgcttttttggctttgtgagaaatcccacggacaattccgtgagccagttatccgacgtagaacagaggaagggaggagcccttgccgaaaaggccatccatggtgaatcgggaacgctccggttcccgttaatgcctaataattatcgtaatataaacaaccgggaatcagtataggccgcaatttttgatgattcaaccgaaaattgttagcgtgctaattaccagcggttaacaagtctttagtgagacttgtcgtgggcgacattggcatggggaaatccggtctcagcgcaatctgcatgagactgcattttgtaacctaacgccgccagaacaacggtagagagcattacgctggtggtggtcagcagcggcgtgctgatgagccatgaaaccaccaggcttgccaggaaacataaccccagttgcagcgtattttgtagcgccgcagcgcgccccgtggcttgagggaaagggcgtaacgcttgcgcgacgacgatagggtagatggcaccattagcaatcgccattacgcagaaaggaatcaggatctccaccagtgaggcattattcagaaggcccgctccccaggtggcgataacgctcagcgcatacagccctaacagccacggaagcaattggtagccctgccatttttgtagcgccgcgcggcaaccatatccgccaatcagaaaagcgatggtttgcggaacatagctcaggccaatcactgccgggctgtaacccatcgcgctgagaataaatggggaccctgttagccacgcaaaaaagctggcggaacaggcggcataaatcagcacattaccgcgataggttttagagcgtaacaacgtcgcgaaagtgagtttatcctgtccttcggtacgcgcttttcccgatggttttaagcgcagcgctggcaacatcagcaacaacgtaatcacgaacagggtggcgaaaatcgcctgccatgagaaatgcgtcagtatccagcttcccagtaagggcgcaagcgccggggataagcccaccagtggcatgatcgtggcgaagatacggttaattttttgcgaaggataataatcggtcaccagcgcttgccagattaccgttgccgcgcaaacgccgacggcctgcacgaagcgcagcgtcagcagtgctgccgcgctttctacccacagcatccccagacttccgagcgcaaagatagataaccccagcagtaaaatcggtttacggccataacgatccgatagcggtccccaaagtagttgcgcgacggcaaagccagctaaaaacaggctgaggctggcgctgaccgcggcggcaggcgtttgtaaatccgcctgtatggcggcaaacgcgggtaggtacatgtccgtagccagaaatcccagcacgctaaggccggctaaccagactaaaaaaccttttccaggttgcatatttgtttctctttcttatcagacagacattgtcgcagagtgtagggagtgaaattacggttgtgaaacgttaatatttgtccagtgaattcaaaatttttgtaggcaaattatgtggtcggaatactcgcttgaagtggttgacgccgtggcgcgcaatggcagttttagcgcggcggcgcaggaactgcaccgtgtgccttcagcagtcagttacaccgttcgtcagttagaggagtggctggccgtaccgctttttgtacgacgtcaccgtgatgttgaactgacgcctgctggcgtctggtttttaaaagaagggcgttctgttatcaaaaaaatgcagatcactcgccagcagtgtcagcaaattgctaatggctggcgcgggcagttagctattgcggtggacaatatcgtcagaccagaacgtacccggcagatgatcgtcgatttctatcgccattttgacgatgtggaactgctggtttttcaggaggtgtttaacggcgtctgggacgcgctctccgacgggcgtgtcgaactggcgattggggcgacgcaggcgattccggtaggggggcgttacgcttttcgggatatggggaccctgagctggagctgcgtagtggcaagcgatcacccgctggcgtcgatgcctgggccgttaagcgatgataccctgcgcaactggccgtcgctggtcagggaagacacttcgcgaaccttaccgaaacggattacctggctgctggataaccaaaaaagggtcgtcgtaccggactgggagtcatcggcaacctgcctgtcggcaggactatgcgtgggaatggtgccgacgcattttgcccgacagtggatagacagcggaaaatgggtggcgctgacgttagagaatccgtttcccgatgcggcctgttgcgtgacgtggcagcaaaacgaggcctcgcccgcgctggcatggctgctggactatttgggcgatagcgaaacgttgaatcgggagtggctgcgggagccagaagaggctcccgacagcggggattaacgccgatagtcgcggaacgggccgtcagcgaccgagcgacgctcaaccaggcgtggatgaacttcaatagactgtgactcttcacgcttattgacgatgcgatccaatagcatattaaatgcggtttcgcctaaagagtctttgggctggtgaatcgtcgtcagcgccggggtaaagtaacgggcgttacgcacattgtcataaccgatcaccgaaacgtcctgcggtacgcgaagccccatttcgtcagccgcgcaaagcgcgcccatcgccataatatcgccgccgcagaaaacggcggtagggcgatgtgactgcgataaaatttgctgcatcgcgtggtaaccggattccggctcgaagtcgccctgaacaatccagttgtccggcacgttgatcagcgcctcctccatggctttcataaagcctgccagccggcccgcgccggtgttgcgctccagcgggccgggaataacgccgatatcccggtggccgcgctcaaccagataacgacccgccatatagccgcctgcaaaggcgttatcaatcaccgtgtcggtaaaatcggccttcgcctcgccccagtccatcaccaccatcggaatatggcgatactcttccagcatggaaagcagaggttctggatactcagaacacatcaccagcaggccatccacgcgcttttgcgccatcatggacaggtaggcgcgctgtttttccaggttattccaggcgttgcctaaaatcagcgtatagcctttctggaaacagtttttttcaaccgcctcgataatttcggcaaaataggccgcttcgctgctggtcgccagtaagcctatcgacttggtatggttaaccttcaggctacgcgcgacggcgctgggagagtagtgcagctctttaattgccgcccagaccgcgttacgcgtttcttcagcgacaaaacgcgttttgttgattacgtgtgatacagttgtagtggaaacgtttgcccgtttcgctacatctttaattgttgccattacatttcactccagaccctcgctaagctcctgagaaacgccaggtaaacgtttgcctacacacaccctaatcgcaacatcagggttgcggcacgccggaaaaacgacacggaacgtcaggaaggggtcaatggccgttacgctaattcagtaagcctggaattttgtctgatcttgaggaaaaggggaagcgttaaaaacagttatcaatataaaacatgagagatttttgtgcgggaatgtgcaaaaatgcgctatatcactttttgtgtgggaataaaaaggagaaaacttgatgagtaccgacctgaaattttcgttgattactacgctgattgttctgggcgtgattgtcgcaggtggattaacggccgctctgcactgatttcctctcttctgagggtgggcgtctcctctattctatccctctctaaaacgcagaaggcgtaccttctgcgtactcagacttatgcggcgagatttttcgcaacaaattcccagttaaccagcgcccagaaatgctccagatagtttggacgggcgttgcggtagtcgatgtaatacgcgtgttcccacacatcaaccgtcagcaacggcgttgcatccgtagtcagcggcgtaccggcatttgaggtagaaacgatagccagtttgccatcagcgctttttaccagccatgtccatccggaaccaaagtttttgatagcggcatcggtgaattgcgctttaaattccgcgaagctgccaaaagatgccgcgatagcatcagccagtttcccggtcggttcgccgccagcgtttggcgccaggcagttccagtagaaggtgtggttccacacctgagcggcgttattaaagatgccgccttcggaagtgcgcacgatctcttccagcgatttgccttcaaacgccgtgcctttgatcaaattgttaagattggtcacgtaagtctgatgatgtttgccatagtgatattccagcgtctcagcagaaatatgcggcgccagagcatctttggcatacggtaatgcaggtaattcgaacgacattgcttctctccttattattaatattgcgcacgcacaatacccctggtgcgcgtaaggatagggtagcaaattgagcggtggcgcaaaagaagaagttatcctgtcgttaaacgacaggataaaatattagcgaattgttttaggcgtcatcacccggcgggcgccgacataatgacgttgccagtattcttcgttcagtgaggtgatcttaatttcctgaccgctgcgcggagactggataaacttaccgttgccgacatagacgccaacgtgatcggcggtgccgcgcccctgcgtacggaagaacaccagatcgccgtttttcaactcgctacgctcaatgggcgccgcgtcacgcaggtgatacatctcattcgccgttcgggggatacggatcttcactaaatctttataggcataataaaccagaccgctgcaatcaaaaccggtgcgcggcgacgcgcctccccagtgatacggtttaccaatctgattcatgagtttggacatcgcggttttcgtcgctttttgtacttttgcacgatgcgcatcggcaatagagaccggcaatgttcctttccccttcacgcagtgcggcttacggcctttacgcgtcgtgcatttttccgttacgtcgagggcggcgattgacgtgggcgcggttctgttacgacgatgcgtcgtatgacgagatttcgtggaggcggtggtacgttttggcgtagaagcggaagaagaacggctggtttttgaggttttttttacgttttttttgctggttttactgatctttttcgttgtgcttttctttttatctgccgttttcgtgacatgagaaacagcaggcgtcgctttggcttgcctggaagcatgggccattggcgtaaaggggagagtagtaaaaagtaaagcacagagcgtgatcgagattttgtttatccgcgccactgagcaatcctctgttaaaggcaggcgattcatgcctgcgtatgatttacaaaacctgataattctaatctacaaaagcacagattggtaattgcttttggtttctgaagctgtgtttcgttaacagatgtaaaaaaatagcaattaatgctaaacacgaacgcgttatctacaaatcactgcgcggcaacccgcttaaaagatattttgtatacaacttattcccgcagacggtaaaataataaggcatgatgaaaatgttattttccgttgccagcctgacccgttacaatgacaggcttcagtcgtaaaagtagtttaaggaagcgagacaatgagcaccactatcgaaaaaattcagcgccagatcgctgaaaacccgattctcctgtatatgaaaggttcaccgaaactgccaagctgtggtttctctgcgcaggccgttcaggcgctttcagcctgcggggaacgttttgcctatgttgatatcctgcaaaacccggatattcgcgctgaattaccgaaatacgccaactggccgacattcccacaactgtgggtggacggcgagctggtcggcgggtgtgatattgtgattgaaatgtatcagcgtggtgagttgcagcagcttattaaagaaactgcggcaaaatataaaactcaggagccggacgcagagtaatctgtgcaaggagaaagcgacctgtaaaggtcgcttttttaccgccatcgtgagcaagagcggcgttgttagcctcgttatttgtccgtcggcaaaggtaacggccagccgcccaggcgcttccagcgattgacaatttcacaaaacagcaccgctgtccgctcggtatcatacaaagcggagtgggccttttcaccgtcaaactccatacctgccgccaggcacgcttttgataacaccgtttgtcccagcgccagtccgctcaatgccgcagtatcaaaggtgacgaacggatgaaacgggttacgtttcagcgaggcgcgctctgcggcggccatcataaaactgtgatcaaaagtggcgttatgcgcgaccataatggcgcggctacaaccgctgtctttgatacctttacgcaccattttgaaaatagcgtgtagcgcctcatattcactcaccgcgccgcgtagcgggttagagggatcgataccgttaaacgcaagcgcttccggctgtaagttggctccagcgaacggctccacatggaaatgcagcgtcatgtccggcatcagccagccttgttcatccattttcagcgtgatggcggcgatttcgagcagcgcatcggttttagcgttaaatcctgcagtttcaacgtcgatgacgacaggataaaaaccacgaaaacggtcgcacagaccggaaagttgagcgttatcggacatctgagtctcttaatacgaaaaaatgcagcgcgtattatggcaaattttacgccgggatgcagtaaaacaacgggcgcagtgacctgcgcccggcgggggatcagttacccagaccgcggcctgcgtctttagcttcaatcaattcgattttatagccatccggatcttcaacgaaggcgatgatggtcgaaccgccttttaccggccccgcttcacgggtcacgttgccgccgttctgacgaatgcgttcacaggcttcagcagcattgtcaacgctcagcgcgatatgcccgtacgcattgcccatgtcgtagctctcaacgccccagttataggttagttcgatgaccgcttcttccgtttccggaccatatcccacaaaggccagcgagtatttgtattccggattctcactggtacgcagcaatttcatgcccagaacgttagtgtaaaaagcgatggaacgctgcaaatcgccgacgcgcagcatagtatgcaataaacgcattttcgttgtccttaaaatagtcaagatattcaaagtatagcggcgatgtgaggccgctatcaatgaaattacagagtagggtagtcagtgtagccttccgcgccgccgccataaaaactttcgggacgctgtggattaagttccgctttacgttgcagacgcgctaccagatccgggttagcgatgtaatcacgaccaaacgccacggcgtcaatcagccctttttcgatcagatcttccgctttttctggcgtataggcgccagcgccgatgatgggaccgtggaaacgcgcgcgcactttttcacggaacgcgtcgctgtacggttcgccgcccgcccagtctggttcagacatatgcagataagcgatgccgcgtttgcctaacgcttcaatcagataaagggcgtcagcttcttcattcgggccgttatcgacattctggaaagtgccgacaggagaaaggcggatgccgatacggtccgcgccccattccttaatgccggcatcaaccacctccagtaccagacgggcgcgattctctacgccgccgccgtaccgatcggtacggtgattagaagacggtgagaggaactggtgcagcagataaccgtgcgcggaatgcagctccaccagatcgaagcccgcctctcgggcattggcgatagcctggcggaaatcgttgacgatcccggggatctcgtgagtatccagcgcgcgcggcgtggaagtctctacgcggatggcctggccgttttcgtcacgcaaagaggtgcgggttcccgcattgatagcggatggcgcgacgggcgcttgtccgcctggttgcaggctggcgtgtgaaatacggcccgtatgccacagttgcaccgccatatggccgccctgggcatggactccctgagtgatttttttccaggcggcgatctgctcatcgctgtgtaatcccggtgcgccggcatagcctttcgcctgtgcggagatttgtgtggcttcgctgatgatcaatccagcgctggcgcgttgacggtaatattccgccattaacggcgtaggaatgtcgcccggttcaatactccgcaaacgcgtcaaaggcgccataaatacgcgatttgtcgccgtgatggcacccaccttgaggggggtaaacagttttgctgatgacatagtggctcctgatataagtagaccggtcgtcttgtaataaaggaaataaaaacgcctgttactgctcaggcgttgcaatgatggtcttaacatgcgccaacgcattttccagcggcgcggcgctacgggatattttggcctgcaaattggcgcccagccacagggcataaagtacctgcgcctgtggcaacggctggccggtgaaatgtaaacagtggctattacggccatcttccagcgcgcgtgcaagcagtgccatgatctcctgcgcccctttatccatcgtagagcgcatatcctccgacagatcgcagacttccgctgacagtttcaccgtcaggcaaccgctgatggcgccttgctggcaaaactgctttaacgtttcctgataccaggcgagaagacgatcgcgatgattaccgggaccggaggtgaagtgcgccgtaagacgctgatgatagcaggcgtaatgtcgctcaagcatggcgacgccgaaggcttctttcgagcgaaagtagtgataaaacgaccctttaggcacttgggcggttttgagcaactcgctaagccccatgccggtaaaaccccgttgcatacaaagctgctcgccggtggccagcagatgttcgcgggtatcgtgttcggtttgcttattcatagcaggcagtatagtagaccagtcggtctactacaagcagagttgccataatgtcagttagcgtcttcaatagtcataagcgtcaaacgttgaggaggggatgtggccgagcagttggagttttttcctgtagcaagcccatgtcgcggtatctgccagtctgatgagcgtggcttttgtcggggctgtatgcgcagccgcgacgaacggtttaactggcaaaaaatgagcgatgtcgagaaacaaaatgtactgcggctttgtcgccagcgtttcttgcgtaaaatacgcgcaaataagcctctcccatcggaagatcctcaacaaccttcactcttttaaacgcggaattgcgtatactcaacctcattattctctatgaggaatctgttatggttcagcgtgtcaccatcgctccacaaggcccggagttttcgcgttttgtcatgggttactggcgtttgatggactggaatatgtccgcgcgtcagttagtgagttttatcgaagaacatctggatttgggcgtcactaccgttgaccatgcggacatttatggcggttatcagtgcgaagcggcgtttggcgaggcgctaacgctggcgccgcatttgcgggaaaaactgcaaatcgttaccaaatgcggtattgcgaccactgccagagcggaaaataagctcggtcattatattaccgatcgccgccatattattctgagcgccgaacagtcattaaaaaatctggcgacagattatctggatatgttgttaattcaccgtcccgatccgttaatggatgcggatgacgtcgccgaggcgtttcaacatctgcaccaaagcggcaaagtgcgccattttggcgtttctaattttacgccagcgcaatttacgttgctgcaatcgcgcctgcctttcaccctggcgaccaaccaggtggagatctcgccggttcaccagcctttgttgctggacggcacattagatcaattacagcaactgcgtattcgtccgatggcctggtcatgtcttggcggcggtcggctgtttaatgatgaggcttatcagccgttgcgccaggaactttccgttatcgcgcaagaactcaacgccagttctattgaacaggtggtctatgcctggattttacgtttgccgtcgcagccgctgccgattattggctcgggtaaaatcgaacgcgtacgcgccgcactagaagcggaaacgctgtcattgacgcgtcaacagtggttccgaatccgcaaggcggcactgggttatgacgtgccgtaatcgccaactcgttgactttccgtacatgttttcgccagtggtttacacttaacaggcgaccacatgtaacggaggttttatgaagcgattaagtttagcgatggtgacgctgctggcctgtgcgggtgcgcaggccgccagcgagaaagtagagatgaatctggtgacggcgcaaggcgtaggacagtctatcggcaccgtcgtcatcgatgaaaccgaaggcggcttaaaatttaccccacaccttaaagcgttgccgccgggcgagcatggttttcacattcatgccaacggtagctgccagcccgcgattaaagacggcaaagcggttgccgcagaagccgctggtggtcatctggacccacaaaataccggcaagcatgaaggaccggaaggccaggggcatctgggcgacctcccggtgttagtcgttaataatgatggtatcgccagcgaaccggttactgcgccgcgtctgaagtctcttgatgaagtgaaagataaagcgctcatgatccatgtgggcggcgataacatgtccgatcagccgaaaccgctcggcggcggcggaatgcgttacgcctgcggcgtcattaaataacccggagccagtgttccctgcgctggagcctgttccagctgcgacagcgaacagtgtaaacgccagataatcgccgccagctcatgcgcggcgggttgatgatgatgtgcgagcgtgtcgcagatacgctgtagttcctgtagcgtgacggcaagcgggcgttgctgcacgccgcgctcgctcatcacatcgcgcagcagggatatacaaatatcccgcacccgggaaagcggatcggaacgcgactcccaggcgcgcagctgccacaccacatgcgagcagttcagcagcaccactccccaacgtaataaccaccggcgcgccagcgcatcctgactattgctgagctgactgacgtgatgataggtcagcgattcaaactcgctttcgttatgggaagggtgacggctaagctgatcgacgaaatcccggcgtagcgcgcggatatggcggcggctttttacggcatcggaaccggggcgcaaaatcgcaaacgccagccaggaaatcgcgacgccgacgatcttggcggtattatcgttaaggaagtcggcgaagtcgtacaccggtggattggtcacggcgatgaatgagcccataaaaacgataagctgcccccacagtcccgccagcttaggcatctgcagtttaagcagttgcatcgtgacgaacagcggaaaaaggaaaagcaagaattgccacagatcggtgatttgcaccatcaggccaaatttcaccacgaagctgaataaggacagcagcactaaagtacgcatcaataaggaaagcgacttaaacggcgtggcgacgatggagtagaggacgcaactgatcgccgccagggttaatgcgccgggcccggattcccattgcgcgccaatactccaggcgccaatcaccgtgagcgtgcaaaaggtacgcacgccgctccagatggcctctgcgttatccgtatgccgcgcaaggccgggagtgcggcggatatggatttgatccaccggcgcgccgctttcgatcagatataactgacggctgctgcgcagatatagctggcaaaaatagcgtaatcgctgccagaacgcgaggtgacgataatcctgttcatcctgcgggcgtagcggcgcaataatctgcgccacggtgtagctgtccgcgcgcggttttgccaactcagctaagagttgctcaatgacttcgcggctgttttccggcggcgtcggccagtttaaaagcattctacgcagactggagatcacgctggttaaccgtaattgctggtgtaacaatgcatttagcaatgcattctggcggcgaaaacggtagtgactccagaaggcctgaatacgcagcaggttcatggtcaggatttgcccaatgaccccctcatgcgcggagcggatagcgtcagtagtctccggctgccacagtagactggcatgttccagcaagcgcgcatgcatgtttttaaacgcggtgagcagggcggtaccatccgatgtgctgggtaggatcatcatcatcatgccgccacagaggatgccgacgataacttcacatacacgtgcctgggcgatatcccacaactgcgtgatttctacaatattaaccatcgggaacgcgatgatcgccgccgtgtagccggacaactggaaagcataagcggcattattggtaaaatgcgcgcaggcccaggtacaaaaaccgatccaggcggccatgctaaataagaacaaccagggttcattcagcgtatggccagcaataattaacgcggcggtcgcgccgagtaaactcccggcaatacgccccagacttttactgattacgccgcctacggtcggaaagctcaccactgcggccgaagtcattgcccagtagggctcatccagattgagataataagcgaatgtcagcgcgagacacatggcaatggtattgcgcaacgcgtaacgccactggccggaggtcgctttaaaccagggcgtatttcgcagggccggcagggagagtttcattaccgctgtccaatggctacgctgcaggtagtgccggagacgagcgtgatatcctgcggtaaagcgtcaaattcgatacgtaccggtacgcgttgcgccagacgtacccacggtacgttgggtttgatatcgggcactaaaccggagtcactttccacgctttggtcgtaaatagcgcgcccgatactgccaacgtgaccctgtaacttaacattgccactatacagtgttattaatgcaggctcaccttcgcggatatggcgtagtttggtttcttcgaaatatcccattacataaaatgaatggctatctaccagggcgaaaagtggcttaccggtgctggcataatcaccggtacgcgtggaaaggttggtcacccagccggataccggcgcttttacttccgtctggctaagctgccactgcgcctgttttaacgttgccagtgcgacatctacgttggcctgcatcgctttaacattcagattggcgctatccagatcttcagcagagatgtagttacgcgataaatgtcgacgtcgatcggcttcattattcgcttttgccagatcggactgcgctttggccaactgcgcctgcgcgttaagttctgcaatatggaagggcgttttatcaatgacaaagagaacgtccccggcgttgacgaactgattatctttgatattgagttgggtaatgctgccagaaacctgtggcgttacgctgacctgttccgcgcggattttaccatcgcgcgtccacggtgactgcatatagtaattccataaccaccacgcggccagaacggcgacgacggcgacaatgagagtagaaaaatattttattgtttttaacgacatatttaccacgcgatcagtaaaacgaggcccagacatacgcaaagcgtaaagagggagagatccattaacaggggatgccagatttcatcagagtatatccggtcacgcaggagtcggtgaataaacaaccagataacgaacccaagcgcaaaggctttaaagaatggcggaaagtaaacagatgctcccaacatgagatcttgtaagggcaatcctgtggcgttgagtatacacttcacaagcaatgttcctttgcgtcagacatcgatgctttagttttagccaaaactgaagctacaggtgccaagtgcgcactatgtctgaaaaaatgtctattggtaagcaaatttagcaatacatttgttttgagaatacaaatactgcacactattctaaaatcagcataataacttagcaagctaattataaggagatgaaattggaatcgccactaggttctgatctggcacggttggtgcgcatttggcgtgctctgattgaccatcgcctcaagcctctggaattgacgcagacacattgggtcacgttgcacaatattcatcaattgccgcctgaccagtcgcagattcaattggctaaagcgataggcattgagcagccatcgctggtacgcacgttggatcaacttgaagataaggggctaatttcgcggcaaacctgcgccagcgatcgtcgcgctaagcggattaaactgaccgaaaaagcggagccgctgatcgctgagatggaagaggtcattcataaaacgcgcggtgaaattttggctgggatttcttcagaggagattgagcttctgattaaacttatcgccaaacttgaacacaatattatggaattgcactctcacgattgaggtgcaggggcatacgtgtggccatgtgaccacacgtaaagcctggtttagcgtggagagacggtaacctggctgccgttgctggccagcacgacacgctgacctgccgagaaacgcgtatttccttgtttctgcacaaccataatggtgttgccatcgtctttacgaatttccagttccacaccctgggttttattcattgcgctctggacgccctggcccgctacgccgccagccaccgcgcctgccgcggtcgccagtgaacgacccgtaccgccgccgatagtgttgccgaggaatccgcccaacaccgcgccgccgatagcgccaatcacgttagaatcatcaccgccctgaatttgaaccggacgaacgttaacgatagtaccgtacgttacattctgaacttgtttagcctcggatgcggtataaacatcacccgaaaggctatcattgttaacacaccccgctagggataaccccatcagtgaaacggccagtacacgtttaatcatttacccatctcctgttcttcacgaaacgctatttcagcatccctatagctaaattatatggcatttatgcagttaaggtcatatcttctgccgaaagaatgtgaaaatcataatcagaagttaattaaccaatcttaaacgaagtcggaagcaagaaaagataggtcattgatatccgtggacgacacggcaaaaaatgtgacgtgggcatagcattacaaaatacgttatgccgagtgttaaggcttaacccagcttaaaaggaagaggtatgaaatcgggccgttttattggcgttatgtccggaaccagccttgatggcgtggatgttgtactggcggcaattgatgaaaccatggttgcgcaacaggcaagtctcacctggcccattcccgttcatctgaaaaaaggcattctcgatatttgccagggacagccgcttacgctctcgcaactcggccagcttgatacccagttaggccggctttttgcacaggcggttaatgcgctgttagcgcaacaacgtttgcagccgcgggatatcgtcgccattggttgtcatgggcaaacggtctggcatgaaccgaccggcgaggccccgcatacgctgcaaattggcgataataatcacatcgtcgcccatacggggattacagtggtcggcgattttcggcggcgggatattgcgctgggcggacaaggcgcgccgttggtgcctgctttccatcacgcgctgttgggacatccgacggaaaaacgtatggtcctgaatatcggcggcatcgccaatttatctctgcttttccccggacaggcggtgcgcgggtacgacacggggccgggtaatatgttgatggatgcgtggatttggcgacaatgcgcgcagccctacgacaaagacgcggcatgggcgaaagaaggtcaggttattcttccattgctgcaaaagatgttgcgcgatccgtactttgctgcgtcggcgcccaaaagtacaggacgcgaatatttcaactatggctggttagagcgccatcttgcggctttccctggcgcagacgcgcgcgatgtacaggccacgctggcggagctgacggcggtctccatcgcccaacaggtgctgctcaacggcggctgcgagcggctgatggtctgtggcggcggtggccggaatccgttagtgatggcccgtctggcggcgctgttgccaggtatcgaggtttcgaccaccgataaggcggggatcagcggcgatgatatggaagcgctggcctttgcctggcttgcctggcgaacgctcgcgggcctgccgggaaatttaccttccgtgacgggggctacagaagccagtgttttaggcgctatttacccggctaacccaataactcagagttaactgaatttttcccggaccctatatcggtaaactagcaaggtcaggaaggggcgtttgcccttccagaagcaggagagctttcgggatatgcctatgaaaaagatcgcaataatgtgtttacctgtgctgctgaccggctgtagcgtttatcaacaatttgttgaacgtatgcaaacggatacgctggaataccagtgtgatgagaagccgcttaccgttaaagtcaataacccgcgtgaagaggtcagttttgtttatgacaataagctgctgaccctgaagcaaggaatctcggcctcgggcgcgcgttataccgacgggatttatgttttctggtcgcaaggcgagagcgccacggtctataaacgagacagaattgtgcttaataactgtcagttacaaaatccgaagcgttgagattttcagtatgggggcgcacaatagcgccacccactgattatttctgatcaacgccatgtctgataacgaccaattgcagcagatcgcgcatctgcgccgtgaatacacgaaaggcggcttgcgtcgccgcgatttacccgctgaaccgttaaccttatttgagcgctggcttgggcaagcgtgcgacgccagactggccgatccaacggcaatggtcgtggcgaccgtagatgacaagggtcaaccgtaccagcgtattgtgttgctcaagcattatgatgaaaaaggcctggtcttttataccaacctgggaagccgcaaggcgcatcagattgagcacaatccgcgtatcagcctgttatttccctggcatatgcttgaacgccaggtgatggtgacaggcaaagccgagcgtctctccactcttgaggtggtgaggtatttccacagccgtccgcgcgacagccagatcggcgcatgggtctctaaacaatccagccgcatttccgcgcgcggtatcctcgaaagcaaattcctggagctcaagcagaagtttcaacagggcgaagtgccgttacccagcttttggggtggttttcgcgtgagtatcgaacagatggagttctggcagggcggcgaacatcgtctgcacgatcgctttttataccaacgcgacgacggcgcgtggaaaatcgaccgtcttgcgccctaaagatgcaaaaatcttgttttaagcactggtgcggatgaatccgccgttttatgctatgtctctttcgcgtctggcgaaaagtcgtgtaccggcaaaggtgcagtcgttttatacatggagattttgatggcaagcagtaacttgattaaacaattgcaagagcgggggctggtagcccaggtgacggacgaagacgcgttggcagagcgactggcgcaaggcccgatcgcgctctattgcggcttcgatcctaccgctgacagcttgcatttggggcatctggttccattgttatgcctgaaacgcttccagcaggcagggcacaaacctgttgcgctggtaggcggcgcgaccggtctgattggcgacccgagcttcaaagccgccgagcgtaaactgaacactgaagagaccgttcaggagtgggtggcgaaaattcgtaaacaggttgccccattcctggactttgattgcggcgaaaactccgccatcgcggccaataactatgactggttcggcagcatgaatgtgctgactttcctgcgcgatatcggtaaacatttttccgttaatcagatgatcaacaaagaagcggtgaagcagcgtctgaaccgtgacgatcagggtatctctttcacggagttctcttataacctgctacaggggtacgacttcgcttgcctgaataaactgcacggcgttgccttacagattggcggttctgaccagtgggggaacatcacttccggtatcgacctgacccgtcgtctgcaccagaatcaggtatttggtttgaccgttccactcatcaccaaagctgacggcacgaaattcggtaaaaccgaaggcggcgctgtctggctggatccgaagaaaaccagtccgtacaaattctaccagttctggattaacaccgcagatgccgatgtttatcgcttcctgaaattcttcacttttatggacattgaagagatcaatgccctggaagaagaagataaaaacagcggtaaagcgccgcgcgcgcagtatgtgctggccgagcaggtgacgcgcctcgttcatggtgaagagggactggtcgcggcgaaacggatcaccgaatgcctgttcagcggttcactgagcgcgctgagcgaagctgactttgagcagttggcgcaggacggcgtaccgatggttgaaatggaaaaaggcgccgacctgatgcaggcgctggtagacgccgaactccagccgtcacgtggtcaggcgcgtaagactatcgcctccaacgctgtcactatcaatggtgaaaaacaatccgatcctgaatacatctttaacgatgaggaccgtctgtttggccgctataccttattacgtcgcggcaaaaagaactattgtctgatttgctggaaataaggcattaagtaacagggagtgagaaatcactcccttatttttgatgttcaggtaaaaaaatgaagaatatcctcgctatccagtcccatgttgttttcggacatgcgggcaacagcgccgccgaatttcccatgcgccgtcttggcgcgaatgtttggccgctgaataccgttcagttttctaaccacacgcaatatggtaaatggaccggctgtgtcatgccgcccagccatctgactgagattgtccaggggattgcggacattggccagttagcgcactgcgacgccgtacttagcggttacctgggatctgccgagcagggagaacacattctcggtattgtgcgccaggttaaagcagcaaatccgcaggcaaaatatttctgcgatcccgtgatggggcatccggaaaagggttgtatcgtggcgcctggcgtcgcagagttccatgtgcgttatgcgctacccgccagcgatattatcgcgcctaacctgattgaactggaaattctcagcaaacatagcgtgaataatgtggatgacgccgtgcaggcggcgcgtgaactgattgctcaggggccagaaattgtactggtaaaacatctcgcccgcgccggttacagttcagaacgctttgaaatgctgctggtgacagcgcaggaagcctggcatattagccgtccgctggtggatttcggttcacgtcagccggttggcgttggcgatgtcaccagtggtttattgctggtcaaacttttgcagggcgcgacgttgcagcaggcgctggagcacgttacggcggcagtctatgagattatgatcgccaccaaaacgatgcaggagtacgaactgcaggtcgtggcggcccaggacaggatcgctaaccctgaacattacttcagcgcaacgcggctgtaattattgctgctaaaaagaggccggatggcggtacagcgagctatccggcaacatgacattaattcagtccttccgctttaagcgctgccgcaacggtcggtctttttgcgacacgctgcatataactttcaatatgcgttaacccgtccatattcagttttacgccataggcccaacgcaatacggtaaacagataagcgtctgcaatggtaaaacgctggccgcaaatccactggtcgtctgaaagcgactcatccacatactgcaatttcttttccagaccggcgcgaacggcgggtttgagtgtttccggcgtgtcagggcggaacagcggggtaaagcctttatgcagttccgttgcaatatagttgagccattccagcgtatgatagcgagcaagactacttaccggcgccagaagctggcggtcgggaacgctgtcggcgaggtactgcataatggcgacgccttcagtcaacagtgtgccgtcatccagcagcagagccggaacctgtcctttagggttgactgccaggtaatcatcaccgttttccaggcgtttttttgcgagatcgacgccatcaagcgtaaagtctttgccaatttcgcgcagggtaatatgggaagcaagagagcaggcacccggtttgtagaacagtttcatcggtaactcctttttgctgaggtttaaagtatggtagtgcggggacgagcaaaaaaaaagccgctaacgcacagttagcggcctgaatgttgtttcccggaaaattaaactgtagcggctttagagcctttttcagcggtatcatcgtcctgggtcatacggttcagcttaggcgctgtcagcagcatcaggacggcgataacggcggttgctatgccaatctgcataaatacgcgaccatagacttccagggacatcagtgggtcagtcacgtcgctcggcacagccatcaggttggcgacataaccgccgatgatgttagcgcctgccgttgtcaggaaccagctacccatgatgaaacccatcagacgctgcggaaccaactgtgcgaccattgccagtcccagaccggagatcatcagctcaccgatactttgcaggccgtagcttgcgatcagccagtttacggatacgatgccggcatcgttcgcaaatttggcacccagcggcagaatcaggaacgcgccggaacacagcaccataccaatggcgaatttcatcggcatcggcagcgtatcgcccatcctgttatagatagcggccagaatcgggctgccgataatgatccagaatgggttcagcgcctgatactgttccggttcgaacgcgataccgagaatagagtgctcgacgttacgaatggcaaagaagttcagcgacgtcggcatctggctgtacagtacgaagaagataatcgcctgcagcatcaaaataaaggcgacgatcattttacggcgagccgcgccgtgcatggaaaacgcttctttaccgaagataatgacgatgccaagagcgattacgcccagcaccatacgtgcgatatcctggttgtgcagcagccaggtggcgaccgcaatcagaacgacaatacccacgatggtcagcagcagattacggaagttgatcggttcaaagtcgggtttggaaccgtagcttttcacccagcgctggcagaaagcaaagttaacgacggttatcagcataccgacgacgctaagcgcaaacgcggtgctccagccataacgcgccgccagccacggcgtcgccagcatagagaagaaggagccgatgttgacggacatataatacatcgtaaatgcgccgtcgagacgcggatcgtccttcgcgtaacaggtagacagcagggaagacgggttagctttaaacagaccgttacccacagcgatagccgccatgcccatatagacgatgccagcgtcatgaccagaccatgcgaccagcgcataaccgatagccagcaccacggcacccagcataataacgcgtttggtgcccagaattttatcacctaaccaaccgccaatggcgaccaggccgtacaccagtgcactgaaggaagagaaaagggtgatggaatccgcttctgacatacccagttgttttaccaggtagacggccataatgccttgcaggccgtaataaccaaaacgctcccataactctatcgagaagatgagatagaacgccttcggttgtttgaaagcgttcaaactgacgctttcagttggttttttgtttgcagtagacacttttacctcttttttacgccccgtattaacagggattgtctggcgcgtgatgagtcagactcatccgtccgattgttatattggaggggaaacggcaggtaatgttcactatctttcctctccagacaagagctttgtaataatctgttacatataactcttctggttgaatcgtccgatgtcagaaatgttatccagcgttaaatttcttcatttgaagaatggcagatttttacactgcaaaaaggccattagtttgggtgaaaggcgatatcttctgctatttaaggtgaaaagcagtgatataggccattatctgaaaaaatggcagagtaatgttttgtagtgaaaacggggcgtcagtctatccggttgtaaatgtaaccttagatgtcattaaatttcacatgaagttatcaaagtgatcctgatcacggatagatagaattttttgcgattaaaaaaatgattaacctgacgtggagtgaaaacgaaagcacattacatcagaaaaaggacagagactggaatgattgatggctaaaatagatccaggccgaaggtgggagcgcgctggcgtgacggacgcactccgaccatatcaaatatcgactttttctttgtattcgcaaagatcttcaatgaggcaggagccgcagcggggttttcgggcgatacaggtatagcggccatgcaaaattaaccagtgatggcagtccactttgaactcattcggcaccactttcagcaacttctcttctacctgctcgacatttttacccggcgcgaactgcgttcggttgcatacacgaaatatatgcgtatcaacggcgatggtcggccagccgaaggcggtatttagcaccacgttagcggttttacgccccacgccgggaagcgcttccagcgccgcccgatcctccggcacttcgccattatgcttgtccagtaaaatacggcaggtcttaatcacgttttccgctttactgttaaataagccgatagttttgatataggatttcacgccctctacgcccagctccagcatcgcggctggcgtattggcgaccgggtaaagtttggcggtagccttgttcacgctgacgtcggttgcctgcgcggaaagcaacacggcaatcagcaactcaaacggcgacgtgaaattgagttccgttgtggggtgcggattgttgtcgcgcaggcgcgtcagaatttccagcctttttgctttgttcatcagactttccctgtttcacctgccggaacagcggaaggcgcggtttcggcgcggcgtttcttcattttttcatcaataagatattttaccgccagcatgagccccaggccgataaacgcgcctggcggcagcatcgccagcaggaaaggcgagtcggtgtgaaatatctcgacccgtaatacttttgcccagcctcccagcaggctatccgcgccatcgaaaagcgtaccattcccgaggatctcgcgcagcgaacccagcacgaacatcgcgcctgtcgcgcccatgccgatggaaaaaccgtccaacgcggaaagccacggtccttttttcgcggcaaacgcttcggcgcgaccaacaacaatgcagttcgttacaatcagaggaataaaaatccctaaagactgatacaaaccgaacgcatacgcattgatcagcatctgtactgcgcttaccaccgaggcaatgatcatgacgtaaatcgggatacggatttctgccggcgtccagcgacgtagtgcggacaccgtaaggttggtcagcgttaataccagcgttgtggccagacccagccccagagcgttggttgccgtagacgtcaccgccagtagagggcacaggccaagtagctgcaccagagcagagttatttttccataacccctgaacaacaatgtcttttatttcgctcatggctattctccacaggcggttaaatgggggagctgagcgggcagtgattcggcgtacagccccgcgcgtttaaccgcattcactacggcgcgcggcgttattgtcgccccggtaaattgatcaaaatcaccgccatcttttttcaccgcccagtgcgtatcattttcaccactgatggttttaccgctaaagtgggtaatccagtcagacaaacggcgctcaattttatcacctaaccctggcgtctcatgatgttccgtcacacgcgtccccaggacggtaccgttgaaatctgcgccaacaataagctggatagcgccggaatagccatctggcgcggtagcctcaatgatggccgctacgggtttatcatccttgcgagcgataaaaacacggtgtgtgcctttgccgagggcgggcgcatcgaccagataacaactctcttgcagattattattgtaacgatctggcggcaatacctgatcgaacagggcatgttgttgttgcagcgcttgttcgtggatggttgattttgtcatctgattaatcaccgcggtcaatcccgtagagcctgcggcaaaaagcgccagcgtaataccgtgtttacgaatcgttttcagcatggtttatcctttgcgatgtccatagacgcgggggcgcgtgtagtagtcgatcagaggaaccgtgatattcgccaacaggacagcaaaagcaacgccgtccggatagccgccgaagctacgaatcagccacactaataccccagccagcgcgccgaaaattaaacgtccacggttggtcgtggaggcggtaaccggatccgttaagataaaaaatgcacccagcatggtggcgcctgacagcagatgaagctgcggcgaggccagcgtagcgggcgagaaaagccagcctaacgcggcgcatagcgccagcgtcagcagaaaactgaccgggatatgccagcggatggctttttgccacagcaggaatacgccgccgacaagccaggcgaggttaacccactgccagcccacgccagccagcgcgccgctgtatatcgggtactgcatgatttgctcaacggagtgcccggcgcgcaaggacgttttaaacgtatccagcggcgtcgcctggctgataccgtcaataccgatacgtagcagcgtcatatcgccgccgctggcggtatgcccggtaaaaatcatccgcaacgtgtccagcatatcgggcgttgttgcggctatttcataaggcggcaaccagcttgtcatttgcaccggaaaggaaattaatagcaccacgtaaccgatcatggccggattaaaggggttttgtcccagcccgccatataactgtttagcgataataatggcgaatccggttcccagcacgaccatccaccagggcgcaagcggagggatgctgaccgccagcaaaagccccgtcaataacgcggaataatcctgcaggtgactggcgaccgattgtttgcgcagcctgaggacaatggcttctgcgacgagcgccgtgatagcagccagaacgatctggaaaagcgttccccaaccaaaaaaccacgtctgcgcggcaatccccggcagagcggcgattaataccagcaacatgattcgcgatgtctggcgctggttatgggtataaggcgagcttgcgattctgaataccatttaatcctcgttaacaacctgctgctgtgctgctttttttgcctgaacgcgggcgatagccgcagcaaccgcggctttacgcgggtcggccggttcggcaggttcgcttccggcctgctgctcctgcttacgggctttggcgcgagcgatggccgcttccactgcggctttgcgcggatcgatcggttcggcaggttcgcttccggtctgctgctcctgcttgcgggctttggcgcgggcgatagccgcttccaccgcggctttgcgcggatcgaccgcttcggcaggttcgcttccggtctgctgctcctgcttacgggctttggcgcgggcgatagccgcttccaccgcggctttacgcggatcgaccgcttcgaccggttcgcttccggcctgctgctcctgcttacgggctttggcgcgggcgatggctgcctccaccgcggctttacgcggatcgaccggttcggcaggttcgcttccggcctgctgctcctgcttacgggctttggcgcgggcgatggctgcctccactgcagctttactcgggtcgtcgccgggtatcgcgctgtcagccatcggatgagcggcttgtttagcgcgcgcttgcgctttacgcgcttcacgggccgcgatgacggcgctattgtctggctgactacccgcctgaataaccaccggttgcgtggcctgcgcctgtttctcttttacccgcgccagcgcagcggcaatggcatcctgatcttttgccgctggttgtaccgctgcgctcttgtgacgtgcaaggcgggcggctttttcgcgctccagtcttgcctgacgagcctcaaaacgcgctttggcttcggcggcgcgtttttcttcaagcctgatcgcattaatctccgctttttcctgacggaaatattggacgagcggaatattactcgggcagacccaggcgcaggcgccgcattctatacaatcagcaatatggtgagcggtagccttgtcatgctgctgccctttgctgaaccaataaagctgctgcggtaaaaggtcggcagggcaagcgtcagcgcaagcgctgcaacgaatacagcttttctcttcctgaggcgctcccatttcagtcacggatggcgccagcaggcagttggtgatttttacgaccggtacgtcaagccagggaagggtgaatcccatcaacgggccgcccatgatgaccatctggtcagcagaagggcagaacccggcatcgttaagcaaatgacgaacgggagtgccgagccgcgcccagacgttacccgggcggcttaccgcttcacccgttaaggtgacgacgcgttctgtgatcggttcgccgtcaatcacggcgcgtttaacggcatacgccgtaccgacgttttgcatcagcacgccaatatcagaggagcgcccgccgtggggaacctgttttcccgtcagtattcgggtgagctgttttgcgccgccggaagggtatttggttgggatcacacgtaacgaaatatcgtgggcgtcagccagtacggcgcgcagcatggaaatagcctgcggtttgttatcttcaatgccgattaatacctcacgcggttgcagaatatgcgccaggatgcgaataccttccacaatctgcgcggcgcagtcctgcatcaaacgatcgtccgccgtaatgtaaggttcgcactctgcggcattgataataagcgtggtgattttatcgccgccgccctgcaatttaacgccggtgggaaaccccgcgccgccaagcccggcaacgccatactgatgaatgcgttcaatgagcgcttcacggctgtgggcgcggtaatcagaccagccctcgcgttcaatccagcggtcctcgccgtcggcatcaatgattacgcttaactccgccagcgccgaaggatgcgccgtcgagtggggggcaatagcgataaccgtcccggaggtgggcgcgtgtaccggcagcattctcccacgtccacgggtaagcgcctggccgcgtagcacgcgatcgccgacgctaacgcacagctcgccctcagcgccaatgtgctgttttaaagggataacaaagcgcggcgctaaaggcacctggcgcagcggcgtgccgtttgactgggtcttcatttcgggcggatgaataccaccgtcgaaatcccagattttatcttttctgaaagcggaaaatagtttaagcatgttgttccacgggaatgatgcgaacgggaatggtgttcaaatcccatttccaactgtcgggcgtctcattcaccggacgtaattcgatgcagtgcgtcggacacggatcgacgcacagattacagccagtacagagatcgctcatgaccgtgtgcatggcgcgcgttgcgccaacaatggcgtcaaccgggcaggcctgaatgcattttgtgcagccaatgcagttattttcatcaataactgccagcatacgtactggcgcagcctgctgttcttcaccatcgcatggttgcggctctacgtttagcaactctgcaattttcagcatgacggcttcgccgccgggcgcgcaacgattgattttctcgccctggagacccacggcttcggcgtaggggcggcagccgggatagccgcactgaccacactggctctgcggcaaaatcgcatcgattttttcaacaaccggatcatcttcaaccgcgaatcggcgggaggcataacccagaatggcgccgaacaccagacccagaagggtcagggcgccaacggcaatccagatagtattcattacaacttcaccaaaccactaaaacccataaaggccaaagacattaatcctgcggtaatcaatgctatcgcgttaccacgaaaaggggcgggcacatccgccacggcaaggcgttcgcggatagcggcaaacagaaccatcactaatgaaaaaccgacggcggcggaaaatccgtacagcgccgactgaagaaagtgatgaccgagattaatattcagtaacgctacgcccagaaccgcacagttagtggtaatcagtggtaagaagatgcctaacaagcggtataacgccgggctggttttccgcacaaccatttcggtaaattgcacgaccacagcaatgacgaggataaaggctagcgtccgcagataaatcagatccagcggaataagtatccaggtgtcgataagccaggcgcatatcgacgccagcgtcatgacaaaggtcgtcgcgaggcccatccccatggcggtttccagttttttggatacgcccataaagggacaaaggcccaggaatttgaccagtacaaagttattgaccagtacagttccgacaaagagcagcaggtaatcagtcatgtttcggcctgaaataaaaaagccgcctattatctgtcaaactaccacaggcgacaacaggttaactgtagggttattacggattaacaaacgttgttttaacgcgcgctgaacgtttgagataaggcacaatgagcgccgttgccaacagtgggaagagtaactgacgcacggcaaaggcatctgagacgggcgaaaaggcaaatgctttaaccgccagtaacaccgacaccagcagccagataatgtaatgcttcggcacgcagcgtctgcgcttgaagaatgcgatcgtcaaccacagggtatagtaccacatggcgatagcggtaataaatgaaatgccccatagcagtaaattaccggtttcctgtccgctaagcgtcttgaacgtttgcggtgtggcaagcgccataacgtagagtaataacgccagcgaggcgctcaacaacgcgactaacagccaggctaacgggccaagaagccagcctccaattcgttgtggcggtgttgtagtcatatcttctccggggttacgcgcattaacggtcatgccgctcattttggggcaaatattataaggtttttgatgttaaacgctactttctttattgcacatagcgccagacggattgcggaacctgacctacatcaaacaggcgtcctccggaaaccagttcggcacggcggtgatctgcagcgcgatacatattaacaatgtccatgtcatcagtaagggtatagttaaggtggtcgaacagtttttccagactttcgagcgaactaattttgcggaattttaatagataatcctgaacagtcatataaagttgatccatattaaatataatgccaacggagtagtcactgataaaaaataaacaaaaccgcaccagtgagaggtcaggggtgcaggtaaaaagggaatattcttaccggtaaagagtcaggcgccacatggcgcctggggcgaaaggttaacgcgctttcctacaacaggcaataaacgtcagaccagataggacatatttcgttttttttgccggtttttgacttttctttgcaccccccggggcgccgcttaccgtaccacgcgaaaatgcctttacattatctgacgcttacttcttctggacggaagccgtgggctctggtggttggtaattgtcaatatggttggcaatacctaaaagaatgactgagataacgagaactatccacccagttaattcaataagacgattcattattgacgacatttgctttgatttatccataaacacagggggtaaatgttactttcctggcgaacggtcggcaagagggagggaaacgttttcagcctctgttctgtaacaagttaatcatttgatgctacgttgatggtcaggacgctattgcggctaatcgcacgatggtgtggaatagcgatatctaaaaccggaggcagtgagatgaatgataaaatccgcgttgggttaatcggttatggctacgccagtaaaacctttcatgcgcccttaattatgggaacgccagggctagagcttgcggcggtatccagcagcgatgaaacaaaagtgaaagcagattggccggcggtttccgtggtctctgagccccgacatttatttaacgatccgcatatcgaccttatcgtgatcccgacgcccaacgatacccatttcccgctggcgaaagctgcgctggaagccggtaagcatgtggtggttgataaaccctttaccgtgacactgtcacaggcgcgagaattggatgcgcttgcgcggagcactggtcgggtactttccgtcttccacaaccgacgctgggacagcgattttttgacgctgaaggccttgctggcggatggcgtgctcggcgaggtgtccttgtttgaatcccactttgatcgcttccgtccccaggtgcgcgaccgctggcgcgagcaaggcgggccgggaagtggtatctggtacgatctggcgccgcacttgttggatcaggccattcaactttttggcctgccggtcagcatgacggtggatttagcgcaactgcgtccgggcgcgcaatctacagattatttccacgcgattttatcctacccccagcgccgcgtgattttgcacggtacgatgctggccgcggcggaatccgcgcgatacatcgttcatggttcgcgcggtagctatgtaaaatatggcctcgatccccaggaagaacggttaaaaaacggcgagcgtttaccgcaggaagactggggatacgacatgcgtgacggcgtattgaccctggttgagggagagacgcgcaaagaagaaaactggcttacgttgccgggtaactatccggcatattatgccgccatccgcgatgcgttaaacggtaacggtgaaaatcccgtgccagcaagccaggcgattcaaattatggagttgattgaactgggcatggaatcggcaaaacatcgcgcgacgctgtgtcttgcctgagatgtcgcatttctccgcctgggatagcattaaaccgcaggcggagagagggcgttagcatcaataaagcaatcttacgcctcggccactttttcgcgcagcgcacgtttttcgctatcgctcagaaaggcgatttccagaccgttaatctgcgcctggcgaatctgttcgcggctcaatcctgccgctggcgcggcgacgtgatattcatggataatatctacgccctgaacagccggatcgtccgtattaagactggcgagaacgccatgctcaaggaaggttttgagtggatgatccgccagcgatgcgacggtactggtctgaatattcgaggtcagacaggattcaataccgatacgctgctgtgcaagaaaatccattaacgcgcgatcttcgacagcttttacgccatgtccgatacgttcggcccccagttcgcgaatcgcctgccagatactttccggccctgcggcttcgccagcgtgaacggtgatatgccagcccgcatcgcgcgcccgattaaagtgcgacaaaaacagactgccgggaaagcccagctcatcaccggctaaatccagcgcggtgatgttctctctgtgcgccagcagcgcatcaagctcctgtaaacatgccgcctcgccgaaggtacggctcataatgccaatgagtcgtgcctcgacgccaaacgtgttacagccgtcgcgtacgccgtcgataacggcttcaaccacgcctgcgattggtaactgatgcgccatcgccatatagccgggcgaaaagcgaagctcgacgtaatgcaggccgttacgtgccgcatcttcaatattttcaaaggccacacggcggcaggcgtcaagcgatgccaggacttttaccccccaatcgagtttagtgagaaagcttactaaatcgggttcggttgaggtgacctggacatgcggaatcagcgtttccagcgtttgggcgggaagggcgatgttgaactgccgaccaagatccagaattgtttgggcgcgaatgttgccatcaaggtggcggtggatgtcagtcaaaggaagcgtaatatcaatcatgggcgcactcaatttttaataaaagtgcgcaccattatactacagattgataatgctctggaaattttgcaaaaacggagtcattacgttgcaacttcgcgagagcgcgggagaaattttgtatcattctctttaacgcgcccccggtcagctcacgggggcgtctctgttatcgcctctcaggataaagggtcaaccccccgcctgtagacagtatcagcgaacggtgcggtggcaaaatccatatccgagatcgtaaaggggagcagatcggcttcgccaaaacgatcggcgacataatcccactacgtacaccatgtcccgcgtcggtcaacttcctgtgaaaaatcgaacatatcccttccttatgcctgaacggtattcatcaggccaaccatttcatcttttaccgactgaacctgcgggccgataattacctgcaaattatgctgattgagctgtacgatgcctgtcgcgtgattgtccttcaatgcctggacatcgacaaacgacatatctttcactgacaggcgtaggggggatgcagttgtccagactcacgatgttttccgtgccgcctaatgctcacgacgagcaccatgtgcggagtcaaacgatagccgctcgcctggtaacgcaaaagtagaggctgcgcgtcgttcggcgcagaccgggtgcagcgtcgcgacacccggcaaggcgattattgttgaggcagcgccggaacgtccggaacggaaagcgccggcatcccaaacaggccgacaaagtcttccaacggcattttttgtccgttgagcgtgatctggccattggcgtactgcaaactggaggcgatagtattatccttcagcgttgtcagtcggaacatctgacccattgcggacagcccctgcacctgctgttttgccagtttttccgcatcatcctgctgatagccttccagttttgctatctgcgtcataaactcgaccgccatgtccattggaattgccagtttcgcatccagcgatttcacggagcggtcgacttcctgcgccagcgtttgtggttgtgccgttgtggttgccggatctttgaggaacagcgacagattcagcgtggtttcccctttggcgtttttccagctaagcggcgccagagtcagtaccggatcgccttttaacagcacggggagagcgctaaagaacgcttcggtgactttttgctgataaagctcaggattctgcgccacgtccggctgattcagcagcgcctgcgtttgcgcatgatattgctgactaaactggtgccaggcttcgccgtcgatttggccgactttcagcgttaatttaccgctgcccaaatcctgattctgcactttcaggctgttaagcgagtaatccaactggctgttaatggtttttccgtcgttgacgagatcggacttgccggtaatttccatcccttccagcaccgccatctctttaccctcaatggcgatggacagtttatccagcgttaacttttggtcgcccacacgttcgccaaagcttgccagtttactggtaccgtcggttttcaaattattaaaggtgagttggaccttctgattatattcgttaacggcatcgaccaggccgctctgcgcttcgcctgacagcgaaaccacattaccgtctttatcggcgttaagctggaactcgccgccgctaaaggcgaccttttcaccggcattctcgtagtttaacggcttgagagagatatcggagcgggtatcgccgccataaccaatgcgggtattgataacaaagggcgcgtcgcctttcgcaatatcaaagaggggttttgccgcatcgttattcaccagagtggtttttaccgacgccatagaagggatcagattgagcgttttgagctgggcgagcgggaaggggccatgtgaaacggactcgtccagcacaatgctttgcccgggcttcaaccaggtattgtctgcgccggcaaccggtttgacaaccagttgcagatggctactgaacacgccgcgctggtagttttgataacttaattcgacaccggcctccggcgcagtacgcttgagctgttcattggcctgagtcaccatttctgcaagatggttctccagctttttccccgtataccaggcgccgcctgtccagacgatgccaagtgcaattactacacctgcagctaccagtgtttttttcatatcaattgtccataaaaatgaaaccaggcggattaaaccgcctggaggagttttacgtctgttataagcttagcaagagttgttaaaaaattcagtacgttgctacagcttgttataaacacgcgctaaacggcccgtgccgctggcgttaaccggagactcatccgcgccgataaaggcagattcacccggcttcagtaccagacgctgttcatctttacgtaacaccgcctcaccctcaacgcagaacagaatcgcggcgctgtgttggccgatgctcgtctcctgaagcgccaggtcgtgcagtgaaaaagcaaaatcgtcaaccggaattgggaagtccagctccgcgccgcttttcaccggggcagtcagcaactcgccggcaggcttaggttcgaacttcacgttcgcgaccagctcagggatgtcgatatattttggcgtaaggccagcgcgcagaacgttatcggagttcgccatgacttccagcgcaacgccctgcagataagcatgaggcgtttcagcaaacaggaacatcgcctcgccgggattcagtttgaccacattcagcaacaaaggagagaaaagcccgctgtcgtcaggataatactctgaaatcacgcggatcgtttgccacggttcgccttgctggctgttaagcgccgctttgagtacggctaacgcgcgggatttttcttcgccttgcatattcaacaggctggcgaaaagctggctcagacgttcagcattcggcacctgcaaaaagtgggcgatagcggaatgcgcgccggcgacaggttgcagtaaagagacaatgtcagaaaattcgcggaacgcgttcatcgccaggaaaggcgtcagggcaaaaaccagctctggtttatggttaggatctttatagttccgctctgcggcatccatggggatacccgccgcattttctttcgcgaaaccgatttcggagttgcgtttattcgggtgcacctgaatagagagcggttgtgcggcgcacagtactttaaacagaaacggcagttcgccgaaacggttggctaccgcttcgcccagcatggcggttttattcttttcgatggcgtcacgcagggagacggtttcgccgttggcggtggtgattcgcgagctgcttttgggatgcgcgcccatccagagttcagccattggctgctgctgcggattggcgatgccataaagttccgttaacgcagttttacttccccaggcatagttttgcactgagttaatgagtttttgcattatcaagccctgtttcaatgtggagatcaatgggaggtattaaaccaagaaacccgcatgaagtaacctccgggcgtaaaaagtcgtacttgtctcagtttttgttaaaaaattgtgtaggatagtgttactcgctttgagtcgggcaatggaacacctgcccagagaataaccataccgagcggtaagtgagagcacaatgtcaaacaaacccttcttttatcaagacccttttcccctcaaaaaggacgataccgagtactacttgttgaccagcgaacatgtttccgtcgccgaattcgaaggacaagagatcctgaaagtcgcgccggaagcgctaacgctgttggcgcgtcaggccttccacgatgcgtcttttatgctacgtcccgcgcatcagcagcaggtggcggatattctgcgcgatccgcaggccagtgaaaacgacaaatatgtcgcgctgcaattcctgcgaaactccgatatcgcggccaagggcgtgttgcccacctgccaggataccggtacggccattattgtcggcaaaaaaggtcaacgcgtctggactggtggaggtgatgaagcggcgctggctcgcggcgtatataacacctatatcgaagataacctgcgctattcacagaacgcggcgctggatatgtacaaagaggtcaataccggtactaacctgccggcgcagatcgatctctacagcgtcgatggcgatgaatataaattcctctgtatcgctaaaggcggcggatcggcgaataaaacctacctctatcaggagacaaaagcgcttctgacgccgggtaagcttaaaaattatctcgtcgataagatgcgtacgctgggcaccgccgcttgtccgccgtatcacatcgcgtttgtcattggcggcacctcggcggaagcgaacctgaagaccgttaagctggcctcggcaaaatactatgatgcgctaccaaccgaaggcaatgaacacgggcaggccttccgcgatattgagctggaaaaagaattgttgcttgaggcgcaaaatcttggcttaggcgcgcagttcggcggcaagtatttcgctcacgatattcgtgtcatccgattgccgcgccacggggcatcgtgtccggtaggtatgggcgtgtcctgctccgcggatcgaaacattaaagcgaagatcaaccgggacgggatctggatcgagaagctggagcgcaatcccggtaaatatattccagaggcgctgcgccaggcgggagagggtgaggcggtgcgcgttgatcttaaccgtcccatgagcgagatactgcaacaactgtcgcagtatccggtatcaacgcgcctgtcgctgaacggcacgattattgtgggccgcgacatcgcgcacgctaaactgaaagaacggatggacagaggcgaaggtttgccgcagtacatcaaagatcatcctatctattatgcggggccggcaaaaacgccggaagggtatgcctccgggtcgcttgggccgactaccgcaggacgaatggactcttatgttgatcagctccagtcgcagggcggcagtatgatcatgctggcgaaaggcaaccgcagccagcaggtgaccgatgcctgtaagaaacatggcggcttctacctgggcagtatcggcggcccggcagccgttctggcgcagggtagtatcaagcgcctggagtgcgtggaatatcctgaactgggtatggaggctatctggaaaattgaagtggaggattttccggccttcattctggtggatgataaaggcaacgatttcttccagcagattcagtcatcgcagtgcgcgcgctgcgttaagtaatgtcgccgccctgcggggcggtaacatgattcgctattttgccggagaacggcgcaagcgccttatccggtctacaccgttgtgttgttatcgttaatactcataagaccgcaaacatgtgagcaatgtcgacacatgatctcatcaacttgagtaaggagcaggtaatggtaacggtacgccgcgagaaagattcaatgggcgcgattgaagtcccggcagataaactgtggggggcgcagactcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatccaggcggctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaggtgcatcccaatgatgacgtcaataagagtcaaagctcaaacgatgttttcccaaccgccatgcacgtggcggcgttactggcgttacgcgaacaccttatcccgcaattatccgcattaacggatacgcttcgcgataaatcccacgctttcgccgatattgtcaaaattggccgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccatccggaatatgcccggcgcgtggccgaggaactggcgacgattaccgcggcgccgtttgttaccgcccccaataaattcgaagcgctggcgacctgtgacgcgttggtacaggcgcatggcgcattaaaaggactggcggcctcgctgatgaaaatcgccaacgatgttcgctggctggcgtccggcccgcgttgcggcattggcgagattgctatcccggagaatgagccaggcagttccattatgcctggtaaagtgaacccgacccagtgtgaagcggtaacgatgctatgttgccaggtgatgggtaacgatgtggccatcaatatggggggcgcatcgggcaactttgagctcaacgtctatcgtccgatggttattcataattttctgcaaacggtgcgcctgctggccgatggcatggagagttttaataaacactgtgcgtcaggaatcgagccaaaccgcgagcgtattacgcagttgctgaatgagtcgctgatgctggtcactgcgctgaatacgcacatcggttacgataaagcggcggagattgcgaagaaggcgcataaagaagggctgacgctcaaagcctcagccgtggcattaggataccttagcgacgaggagttcgacgcctgggtacgtccggagttgatggttggcagtatgacgccgggacgttaatccgccacatacaggtgcagtcgcggaataatcagtcgcagcggctgcgcctgtggtttaaaacggtgctgaatattgtcggcgtcatagttttccagcccgccaatatccggcacgccagcgccgttgtccgtgttgattaatgcgataatcggcgtggggcaggcgtgttgcacctgtttctgctggcctttataccagatgcgggagatcggctgtactttaaccggacgcttaatcttgagtcgggcctgctgcggtaaggcagcgatatcctgatattcccgttccagcttgaattgccattgttcgcgcgtccacggcgggacgctgcgcggcgacgcgaggctttttttcaactggctcagaacctcatcccggcttaaatttttaataatatgtttatttgcccagccgaaacgtatggtggcggggttattgataagcgtcagcgtgcggtaagcgttcagcgtaattaagccgggtagatgccgatgcacccactcaaaacgtgccgctgagggaagaccggactctaccgtaaccatctgctcgaaggtggttttcaactggttaatgcgctgtatctgattttccagatctaactgtgtcgcattatccacttgatagcataagacgccaggcaggcggacggcggctttactgctgcggttttcggactgctgttgaataaacaaatggcgatagtgacgtagcgccagcgcttcggcctctttccccagatgttgcgttacctcgatagtatccagcggcgcatgttccgcctctttggtcacctgcggcagtgaaaagacacgggcgataagtagcgaatgctgctgtagattatccgtcagcgccgccaggtgttgttctatctggcgaaaagtgccattcaggcgttcaacgagatcgtagcgggacatggtatcactcactttagttacaacatactatatgtatagcacagttcccgccgctcaaccagcgtgcaaaatgcgtcaggcagcggtcatgtcgggcatcgcgtgccagaccggccagcgaaagctaaattttgcgccgcccagttcgctctcgtcacagacgacgctaccgcccatcgccagggcgatagagtgtacgatggcgagtccaagcccgcagccgcctgtcgcccggtctctactggggtcgagtctgacaaaaggttcaaatacgcgctctcgcgcatccgcttcaatgccggggccatcatcttcgactatcaacgttgcctgactgccgtcgagtaacagactgacctgaacggtggtatgactgtagcgcaacgcattattcagcaggttatccagcactcgcgacattaaccgcatatcaagcgcgccataatcgccgattacacatgtgacaaggtttacggcacgttccggggtcacgctctgcacatcctgcaaatgcgcgagcaaccaggcggggaggtcgggttcggtcaacatcagttcattttgtggtcggtcaaggcgcgcataggtgagcagttcttcaatcagcgcttccagttgaccaatatcgcgattgagcgcctgtgattccggcggtgtcagattttcactcatttcaagccgatagcgtaaacgtaccagcggcgtgcgaagctcatgggcgataccgtcaatcagctgttttttactggcgatcagggcattaatgttatccgccatctggttgaacgcgacgcccagacgttcgaaactggagccattatcgaagtgcaggcgttcagtcaaatgaccctcgccaaagcgctgcgcggcggattcgagcctgagcatttcttgccagtgcgggcgcatccagataaacacaggaaaggcgagagaaaaggcaatgagcgccattaaggcgatatccagcagtcgcatttgatgcaggaaatagagatagggaaccgggccaaccgccaggacgtaatggctgcgcgggatacgctgaataaaggtgtattgatcgtcaagcgcgacaatatcgccttcacgcagtcgctgcgtggtggcggcatcaagcttatagtgatttaacggttcaacgcgtaaatcgaaagagaggttcaggtccatctcttttaacgttttcccccattcacgcggcggaatttcccgcagttcgctgcgcatcagatagagcgaacttttcatcagatcgtcgagcgattgcctgcccgcgcgttcggcggtgaatttgtacaccagtccgaccaataaggtcatgaccagaaaacagacgaacagcaaaaggtaaaactgcacaaacagctttttcatcaacgcccaccggatctcaatacattagctctatcgcgcgctgacgaaaaagatttcccgtcagcgccgctggtgggttataaaagcaggctttgcgtcaactgacaacctcattgtccggcgttaaggtccggactttcgtgaacaatgcgtccatcgacaagcgtcaaaacagcgcgaatggtatcaattctgtcttccggcatcgtcataaatggctgattgagtaccgccagatcggcctgttttccgacgcgaagctggccccggtgttgttcggcaaaggcgagccaggcggcatgacgtgtatataacgctagcgcttccagacgcgtgagccgctcgctggcgggtttacgcacggaaccgcctgacgctataccggtgatatgatattcgatagcgtgccagacaccggcaatgccaatacgcgtcgaatcggtaccgccagctacgacaagccctttatccagcgccagtcgaaccggcggcgaattgtccgtcgcgccgggtggattggcgtcacggatggcaagcccctcaaagtaaggccccatttgcacagtgtatgccagacccagcttacgcattcgctcaagcgtctgtggcgaaccggtattcagatgcgcaatagaccaacggagagggcgcagatcgtactgctgagctacctgctcaaaaatcgtcaatatcgcgtcggcgctatcatcggtataggcgtggatctcaagcggtattccccgttttgccgcaaatgtcgcgacctggcgaagcgcggttttgtcctgctctgaggaagaaaaccctggggccatccgcacgccgtcattcattccggccaccaggctttcccccaggccaagaaaagccagttgcccgtcatcggcacgcgccgggcgaaaggccatcaggttgctgaaccactgcgcttcatgacctttcgcttctggctgtaccggaatgcgataccccacgcgcagcggtaaatccccctggtttcgcattgcaaataaaggctcataagcggcggcaggcccggcagaggggtcaatgatgccggtcacgccgcgagcgttcatatcagcgaaaaattgccgcagaccaccctcacgatcggcgttacgacttatgctggcaaaaagctggttaaacgcggcgatgtcaccaaataatttccccgtggcgctaccttttgcgtcgcgctctacgcggattcccgctaaatcaggaggaggggtgttgttaaggccaagtacgtctataccgcgctgattcactaacgcatagtcgtaaagatactgaatataagccggatgatcgggaagggcgtgactcagttcggctaccgtcggcgcccggttttctgcaaattgcgccggtatccacgatcccactacggctacccattgatcgtggggacgacggttagcgtcggcgcgtaatttatccagcgcgtctttaagcgaagggctgtcgtaccagtaggtttcgaatgtccaggtttgtccgccgcgaatggcgtggatgtgagtatcggtcaggccgggtatcacggttttaccctgtaaatcgatggtacgggtatggtcgccgcgccattcatttgtcgccgtatcatcgccaatcgccacaatccgcgagccggaaatcgccagcgcgctggcctgcggctgggcatcattcagagtgatgatattaccgttatgcaaaataatatccgctgccgggcgggcggcggtggctgcgcctgtggccgtgagcagaaagagaagcgcggttctggaaagcagagacgggacgagactgatcattagcatgttccttttgtcgggcgataagcaaaccatagagagcgaacaagaattgttcaatctgtgcccagggaactgtgcgttctgtttttagaacggtggtgatgaaaaaagaaaagcccgccgaaacggcgggcttgagaagaattaatgaataattagaactggtaaaccatacccagcgcgacgatatcatcagtgctgataccggcatctttatagaactggtcgtcatcatccagcaggttgattttataatcaacataggtggagaagtttttgttgaaatagtaggtagcacctacatcagcatatttaaccaggtctttatcatcgccattaacgttgttataggtcaaatctttacctttagacatcaggaaagaaaccgccgggcgcagaccgaaatcaaattgatattgggctgtaacttcgaagttttgcgttttgtttgctacgcatgagcgacaatcgtcattgccgtaaggcgtcatattacgggtttctgaatacattgtggccagatagatattattagcatcatatttagcgccaacagtccatgcatccgctttatcaccgccagcggtagagtaattaacctgaccattagtacgatcggaagtggtatatgccgcgccgaaacttacgcccatacccagatcataagttgatgagataccgaagccgtcaccgttagcgttcttcacgttacgatcgccgccgttattagtgccttcctgctcatgagaaacctggttttcattggcaccctgatattgcaacgcgaagttcagaccgtctaccagaccgaagaaatcagtgttacggtaggtggccacgccgttagcacgaccggtcatgaagttgtcagcgtaagtgtaggagtcgccgccgaactcaggcagcatatcggtccagccttctacgtcgtacaggacgccgtagttacgaccatagtcgaatgagccgtagtcgccgaatttcaggccggcgaatgccagacgagtccaggaattagcaccttcgccttcggtagtgttagcctgaacgttatattcccactggccgtaaccggtcagttggtcgttaatctgtgtttcgcctttaaagccgacacgcatataggtctgatcgccatctttagaagagtcatcagagaaatagtgcaggccgtctactttcccgtaaaggtccagtttgttgccgtctttgttataaatttcagcggcgtgtgctgcgccagcagccagcagagccgggatgacaagtgccaatacttttcttttcatttttttatccttaaaaacttaacttatttgcaaaagattgaacttctacagattcgttgaatcaaaggcatcctaatctgaataatattatttcagcaaatgctaacttttcttatatgttattaattaatacaaaagttactatcggaaacgcatatatttatggtgaatatatttgttattatgtattcatgtatgtgatttgttttatttcacaatttgcgaaaaaagatggcaatatagcggcgggcagacattctgttatcaattttgtgaactggcttcgagtttttttaatttaactttcttgagcgaaaaagacgtaatcatgaaccacaacgcagagaaaacggtaataaaggggccgtttcgactaataaaaatagcattcatgtatgcaatgtctgttttttgaacagtggcggtgatgagcatcgccactatgacttgataaaggcaggtaaaatctgtcggctaacttatcccgtcgtttcgtcccaggcatgaggggcaaaaagatagcctttattgcgaatggtctttatacgatagggctcagcagcgctatccagcagtttcttacgcaggcgggaaatcgctacatccacgctgcgatccagaccatcataattgacgccgcgcagcgtttttagcaacgcgtcgcgatccataatttgtccggcgtgtgtcgccagttcccagagcaattcaaaatcggcggtggagagcgatatgaaatcgccattgagctggaccgcccggttaaggggatcgatggttaacgcgccaaaacgcagcgctttatgcggcgtaagcgcgctctcctgaagactttttgcctgttgcgtttgttcgctttgccgcaggtgtaagcgcagacgcgccagcaaaacggccggaggcgtggttttgaggatgtagtcgcaggcgcccatctccagcgccagaatatgattcatatcactgtccagcgaggtgagcaggacaatcgggccttgccagcggtggcgtaaatcgcgacatatcgtcatgccatctttacctggaagcataatatccagtaaaaccagatcgggctgagtggtgaggataagatcctccgcccggtcaccacgcggctcaacaatgacatcaatatcatgtttcgccagataagcggcaatgagagaacccacttcagcgtcgtcttcaacaaatacaatgcggttcatattataaatggagaatagaaaacgccaacatacaccgcctctgttttcccttccataaatcttttctaaacgagagcggttccgttatgctacacgctgttgttattagcgtgttaaggcaaggtaatgggactcgtgattaaagctgccctgggggcgctggtcgtcgtattgattggtctgctgtcaaaaacgaaaaattattatatcgccggattaattcctctgtttccaacgtttgcgcttatcgcgcactatatcgtggccagcgagcggggcatcgacgcgatgcgtaccaccatcgcctttagcatgtggtcgatcattccttatttcatttatcttgcaacgctatggtatttcagcggcgtgatgcgcctgcccgtcgcgcttggcggtgcggtggtctgctgggggctaagcgcgtggctgctgattttttgctggattaaatggcattaatattggcaaagaccgtggtttccccatcgtaatacagacggatattacgatggggaggttgtcaacccaccagcatccacgtagccggaaccgccgcgaccagcaataaaccaatcagcacgacttcctgacgatttaacacgttgtcatgcttgtgcgtccgacgcgcatacaggaaaaccagtaatccaggcgcgtacagtacgacggacagcagcaggtgcatgggacccgacgcgtataacaaccataagccataaatacaggctccgataccgaccgcccgatggaggggacgtgttgcaatcttcagcagaaatgcgccgaccagaaagtagggcaccagaatcatttctgacgcaatcgtcaatagcgtgttgtagtccgaaccggtcagccagatcagcaccagacagatttgcacacagatattggtgagccataacgatgcagaaggcgcgccttgcgcattttgtcgcgcgaagatgcccgggaaggatttataggctgccgccagaaatggcacctccgccgccataatagtccagcttagataagccccgcagacagacacaatcagtcccgctgcaataataatttctccccacggccccatcatttttaccattagtccggccatcgacgggttacgcatctccgccagttccggacgcgcaagaacgccaagagaaagcagcgtgaccaggagatatattcccagcgccgcgaggaccgccagtagcgtggcgcggcctacatcgcgtttatttttcgctcgggccgagacgacgacggcgccttcaacgccaataaacacccacagcgtaataagcatggtgttcttgacctgttcccatacgggaataccgagttcaacaccagtgaagtccagtgtgaaggtatccagtttgaacatcatgatagccagcacaataaacgcgccgagcggcaacagtttcgccagagtcgcgaccagattgatgctggctgccgtttgtacgccgcgcaggatgaggaaatggacaatccagagcaagactgaagcgccgacaatagcctgccaggtattaccgtcaccaaacagacgcaaggcaggcgtatcggtaaagaaactcagcgctgaaaagacgataaccaaataggatacgttggcgatgaccgcgcacagccaatagccccaggcagaacaaaagccaatcagttcgccgaagccttcgcgggcgtaagtaaagataccgccgtcaagctcggagcgaatgcgcgtaaggattaacatggcgaatgccagtaagagtatccccacgccggtaatggcccagccaattaacaacgcagccggactggcaacggcggccatattctggggcagactgaaaacacctgcgccaagcattgagcttaaaaccagcgcggtcagcgcgctcagtcccagttttttttccattggtatccagctataaaaatgaaattggaagaataattattatggcaaaacgcataaaaatggtgaaagccactaaggcgcgggattttacggagagaagggaccgcatgcaacggcctggataagatttatcgccaaaaaagcgaaaagtgagattcatcgcgatatttgacggaactggcatcccgcgagaaagtgccggatggcggcttatcaggcctgccgttgaacgatcgtgtaggcctgataaggcaggtatgccgccatccggcgagaaagcctgatggcgacgcgcgccttatttatagaggtcggcgctgatggtgatgttattaccgcgctcctgccactgacgcgtaatatgataatacttagcgcctttcttcgccgcgcgtttggcgacctgataggagatttctgtcatattgccgtagttgccggtgaacttaacgctgtcgaaaggcaccatcatcgcagccgtcgctttattcagctcctcaacttttgtgccatccggaagtgtgacagtgtaacgtccgcctttggaggattgcgtttcgaagaaacggcctacttcggcgctcggcgaggctgacgtggcgacgcctggaatttcgactttcttcgcagcttcgccgccctgagccagcgcggcgcggccagcttcagagtctgccggaatagcgtccgggctctggacgatgcgttttttcgcatcttgtttatagataaatgcagtgatgcgctggtttccgccctgattcgcatctatctgacgaacaatatagaaagcgtatgcgcctttttgtttcgccgctttcgtaatggcatcgttaacttccggctggctacggtagaagccctgaacggtgacggtgtcatacggttctaattgtacggcctggtctttcggtaattccacgatgccattaatgacacgatttttgggcgcgtcggctttcggcgcgtcggctttatacacgtccgccacaacacgccagttaccactgttgccgaactccgaggtgtcgacaacatagaaggaggctgcgccttctttatctgcgcggcgggacacggcggagaccgcatcgccaatagcattaaaacgaccggtaataacgatgcggtcataaggttttagtgcagccgcttgctccggcgtcagttctgttgctgcatggacagaaaaagcagccgcagaaagcagagccgacgccaggagagtgttcttaagcttcataaaaataatccttcgccttgcgcaaaccaggtactggtattgttattgactagaaacgtggctgattattgcatttaaaccatatggatgtctgcgggatttttcacgcatcgtgtcatgtatcctatctttgatgataacatttgccgatatgtcgaaaaaaacggcgtccgggcggctaagctaatgaagcgcataaatttaataagttaatttaatgttaatttcttgatcgcgccaggggtttaatgatgttttgctgtcaaatttgagcgaattatcagccctcgcaggccattttcaaggcattatggctgcttagcggctgaatcgttcatgttttgcaaatttgataaaaaattctgttttttggcgctagatcacaggcgttattttcagtaggttatagagagtttgtaacggttttattctgctggggtaacatttacctcaaacgcgggcaggcgtacgcttctcgcgcttactgacaaaccatcatcaaaaatatcgatggaagggaacatttatgcgaattggcataccaaaagagcggttacccaatgaaacccgtgtcgctgcgacgccgaaaacggtagagcagctactgaagctggggtttagcgtcgctatcgaaagcggggcgggtcaactggcaagttttgacgacaaagcgtttgcgcaggctggcgcggatattgtagacggcaatgctatctggcagtcggaaattattctcaaggttaatgcgcctgaagaagaggaaatcgctttactgaaccccggaactacgctggtcagttttatctggcctgcgcaaaatcctgggttaatggagaaacttgccgaacgtaaggttacggtgatggcgatggactccgtgccgcgtatttcccgcgcgcagtcgctcgacgcgttaagctcaatggcgaatatcgcgggttatcgcgccattgtagaggccgcgcatgaatttgggcgcttctttaccgggcaaatcaccgccgccgggaaagtgccgccggcgaaggtgatggtgattggcgcgggcgtagccggtcttgcggctatcggcgcggcaaacagcctgggggcgattgtccgcgcgtttgacactcgtcctgaagtcaaagagcaggtccagagtatgggggctgagttcctcgaactggattttaaagaggaagccggtagcggcgatggttacgccaaagtgatgtccgaggcgtttatcaaagcggaaatggcgctctttgccgcccaggccaaagaggtcgatatcatcgttaccaccgcgttgattccgggcaaaccagcgccgaagctgattacccgcgatatggtcgattctatgaaggccggcagcgtgattgtcgacctggccgcgcagaatggcggtaactgcgaatataccgtcgccaatcaggttgtgacgacggacaatggcgtgaaagtaattggctacaccgatctaccggggcgtttgccgacgcagtcatcccaactttatggcaccaacctggttaatctgctgaagctgctgtgcaaagagaaagacggcaatattgacgtggattttgacgatgtcgtgatccgtggcgtgacggtgattcgcgacggcgacattacctggcctgcgccgccaatccaggtttccgcgcagccacaggccgcgcctaaagcagcacctgcgccaaaagagccggaaaagcccacttcaccctggcggaagtatgcgttaatggcgctggcgatcattctttttggctggctggccgatgtcgcgccaaaagagttcctcggccattttaccgtgtttgcgctcgcctgcgtggttggttattacgtggtgtggaacgtgtctcatgcgcttcatacgccattaatgtcggtgaccaacgcaatttcagggattattgttgtcggggcattattgcaaattggtcagggcggctgggtcagcttcctgagctttatcgcggtgcttatcgccagcattaatattttcggtggcttcaccgtgactcagcgtatgctgaaaatgttccggaaaaactaaggggtaacacatgtctggaggattagttacagctgcatacattgttgccgcgatcctgtttattttcagtcttgccgggctttcaaagcatgaaacgtcccgccaggggaataacttcggtattgccgggatggcgatcgcgttgctggcgaccattttcgggccggataccggcaacgtggcatggattctggtcgccatgattattggcggcgcgattggcatccgcatggcgaaaaaagttgagatgaccgagatgccggagctggtcgcgattctgcacagtttcgtgggcctggcggcggtactggttggctttaacagctatctgtaccatgacgccagtctggcgccggtgctggtgaatattcatctgaccgaagtcttcctcggtatctttattggcgcagtcactttcactggatcgatcgtagcgtttggtaaactgcgcggcaaaatctcttctaagccgttgatgttgcctaaccgtcacaaaatgaacctggcggcgctggttgtttctttcctgttgctgctggtttttgttcgtaccgaaagcgtgggtctacaggttctggcgctactgctgatgaccattatcgcgctggcgtttggttggcatctggtcgcttctatcggcggggcggacatgccggtggttgtttcaatgctgaactcctattccggttgggctgccgcggcggctggcttcatgttgagcaacgatttgctgattgtgaccggcgcgctggtcggttcgtcaggcgcgatcctgtcttacattatgtgtaaagcgatgaaccgctctttcatcagcgttattgctggtgggttcggtactgacggctcctcaacgggcgacgatcaggaagctggcgaacatcgcgaaatcacggcggaagagaccgctgagatgctgaaaaactcccactccgtcattattacgccggggtatgggatggcggtagcgcaggcgcagtatccggtggcggaaatcaccgaaaaactgcgcgcgcgcgggatcaacgtgcgtttcggcattcatccggtggcgggtcgcctgccggggcatatgaacgtgctgttggcggaggcgaaagtgccttatgacatcgtgctggagatggacgagatcaatgatgatttcgccgataccgataccgtgctggtgattggcgcgaacgatacggtgaacccggcggcgcaagacgatccccgcagcccgatcgccggtatgccggttctcgaagtgtggaaagcacagaatgtcgtggtctttaagcgttcaatgaataccggttatgctggtgtgcagaacccgctgttctttaaagagaatacgcaaatgctgtttggcgatgccaaagccagcgtggatgcgattctgaaagcgctttaatcttttaaacgtgcggcggcctcttcggaggccgtttttatacacttcatcctttacgctgcctctttgttggctgcactcagaaaccccggtcacatcgttatctatgctcccggggatttcttcccttgccgccgcgatgcatcttgaatgattttgtgtatgtattgcattttatcttttgtttaaatcgctaagcagaacggcgatactctgcccgccggtggtctgttcgagggcgattttgacaatgatggttaacggaacggagagcaacatgcccaccggacctaataaccagccccagaaaattaacgacaaaaataccactaaggttgaaagacctaaaccacgtcccatgattcgtggctcaaggatattgccgaagaccagattaatcagcagatagcctgccagcaccagcagcgcatcataaaacccgttaaataccagcacctgaataatgggtggcagggcagcgagcaccgatccaatattaggaatatagttcagcgcgaaggccagtagaccccagacaaaggcgaagcggacatccagcgcggccagcattccccatgcgaccagccccgtcacgatactgatcgctgtttttaacaccagataatgggaaacgctatcaagcgcgcgttgaattgccgccataccttctaccgggcggctcatcatctgctgcagtttttcaggcagttgtggaacctccaacagcataaataccacggtcaatagcaataaaaagatggatgacatggcattggacagttgggtgagcaggttcgttaccagagtcatggcggcgtttggatcgatatatttcgccagctcatcaaccgacacgccaatgccagctcgctgcaaccacggttcaatacgttgcaacggtatcaccaatgaggagcgatattgcggtagggtacgagccagttcatttaatgatgtccccaaataggccagtagtagtaccattaacataacaataatcacaatgagcaatgatacggcgataacgcgcggaattcggcatcgggtcatccgttgcacaacgggattgagaacgactgcaataaataacgccaaaataaagggaacaatgatatctgcggcgaagcggataccgctcagaataactaccagcattcccagcataatgacgatttttagaccattgagcgtgatgatcggttttgccatatcagtccctgttttctgatgccgacacgaataataatgtgatgtcggtcgacctgttctggttaaaatcaaacacttcaggtaaagaagtgaaaatattttgagttaattcctggcttatgatacaaatcaggcgtgttcaactaccgaggacaattatcatccgcgatgacgagaagcaacactgcggataattgtaatattatggacaatatgttcagcgcttttttctccacgcaaacgcatcttcactctacctcctttttcctgcttatcggcgagcagcactggcgtaacgcactttagtctctcacttctgcctgagctggcgcaatgcgctgtgctaactgattttattttttagtttgctgcgtgcagcagactcgaaagagtatattctcatgcaggagaagtgtcatgttttactggattttattagctctggctatcgcgactgaaattaccggcacgctctcaatgaaatgggctagtgtgggtaatggcaatgcgggttttattttaatgctggtgatgatcacgctgtcatatatatttctttcttttgcggtaaaaaagattgccctgggtgtagcgtatgccttatgggaagggatcggcattttatttattaccatttttagcgtgctgctatttgatgaagcattatcaaccatgaagattgccggcttgctgacgctggtcgccggcatcgtattgatcaaatcagggacgcgtaaacccggcaaaccggtgaaggaggcgactcgtgcaacaatttgaatggatacacggcgcctggcttgggctggcaataatgctggaaatcgcggctaacgttctgttgaaattttcggacggctttcgccgtaaatgctatggcatcttatcgcttgccgctgttctggccgccttcagcgcgctttcccaggcggtaaaagggatagacctgtcggtggcgtatgcgctatggggcggttttggtattgccgctacgctggcggcgggctgggtgctcttcggccagcgcttaaatcccaaaggctgggttggcgtgatattgctgctcgccggaatggtcatgatcaaatttgcctgagacgatcgctgccggttggttcaggcagcgattcccgcattaatcctgcgccagagctttcagcttatcgcgaaagccggtgacggatatagcgcggttatcggcgcgccagcgatctttagccgcaggggcggagctttgtacgccaataagctgccatccgctatccgtgtgcaataagagcggcgagccgctgtcgccaggtaacgtgtcgcactggtgtgagagtacggcattctgcgcccagccggtcacgacgcaatcctgatgggaatagagcgcattcagatgatcttccggataaccggactgcgtgacttttcggtctgcggctttcaacgccgcagtgagcgccgctttatcgccggtaaataaaggcactggcgtgataccggaaggtgggtagcgcaatattaccagaccaaaatcccagcttgccgcggcaggcggcacaatccagccatcgccatccgctttcaggcgtcggcccagcgacggttcaacgcggccttcaatgccgtggatttcatagcgccatactccttttcgcgccacaaaacgcagcgcaaccgccttgtctggttttcctttcggtggcgttagcaggcagtgacctgctgtcagggcgatatgcggggagataagcgttgccgtacacaaattaccgctggcggtctctagttgcccgatggcatcccacggcgattgggtaggatcggcgacgggcacccgatcatcatggttaaaaaaaagcgttttaacgtcgctggcatccgtggcgtctgtttcagcccccccggctttcgccataaccggtaaaaaacacactatgcccagtaatacagcaatggttttatgcatatcacactctggtgggtaattatgattattaacaacaaaccctcagtactactatagacgtgacggtaagaaagtgggagtaaaatcagataactacactcaggaaagatagaaatgcgtggcaataacggcgcataaaataagcacgataagaatgagctcaaagcggtagcgagacacttttttgccctcccggaaggcggcgctaaaccagaacaatttagcgccgtaaaaacgggcgcgggggcgcgccgcagcatgttacgacttacgcagccggttgagtagttggttttgacgtggttttggctggcgctttaccaccttttttctggtgctttttagccgcctgcgctttttgctcaacggttttcttatgctgttttttgtggtgctgggtggtctgggttgttttggcaggcgctgcggttttcgcaggcgttgcagtctcagccgcgaatgctgcggaagagagacccattgcagcggcaacaaccagagctaatacttttttcattttgataccctcgatttggttttcattcaaccccactgcggggccggtgaaatgactatatcgctgttatcaaaaggcttccgtgagtgattggtttcggcatgtaacgttatgtacaatcccccggtaacgcgatgtcagcccccaccataataggtagctttacgttaccggccgttatttttggtcgcagagtcggtaatatccgccatccagaataacaggcacaccgtatatgaatccgataatctgggtggtatttacgcttctggcgctggatgcaatcagagaagttatgggcgtatcaagcttgacaggtctgtggtgaacagtgaatcgtggcgtgaaaccagcccggcgatagcgcacgttgctatcgccggattatttcttttcaggcgtgaagacgatgatgtaaccgcgtcccgaccaggatggccagcaccagcattagcgcgataaaaccacctacgccgttccagccgtaactatgccagaatacgccgcctagcgtcccggcaatactggaccccagataatagctgaaaagataaagtgacgaggcctgtcccttcgcccggcgcgcacgcgggccaatccaactactggccacggagtgcgcggcgaaaaagccggcggaaaaaagcagcatcccggcaaaaatcagccaaagcgaggtaaaaagcgtcagtaaaagcccacccagcattactgcggtagagaacagcatcaccggcccccggccatagcgtgaggtcattgcgccagctttcggcgagctccatgtgccggtgagataggctacggataacagtccgaccacggcctggcttaattcccagggggagagcatcaggcgatagccaatgtagttaaacagggtgacgaacgcgcccatcagtaaaaagccttccgcaaacagcagaggtaaccctcgatcgcgccagtggagacgaaaattaataaatagcgttttaggccgtagcgacgtgggacggaaatgttgcgaggcgggtaaaatcttccagaacatcagcgcggacgccagcgcaaagcatccgatggccgccagcgcgatgcgccagttaaaaaagtcggtcatgacgccgcttaataaacgtccgctcattccgccgatggaattaccgctaatgtagagccccatagagaaagcgacaaagctgggatggatttcttcgctcaggtaggtcattcccaccgcggcgacgccgcttaacgacagaccgatcagcgcgcgcataatcagaataccatgccagctggtcatcatggttgataacaatgtgcagcaggaggctaataacaaggcggtgaccatcaccggtttacggcctatcgcatcagaaagcgggccggtaaaaagtaagccgatagccagcatggcggtagaaatagaaagtgaaacgctgctgctggcgggggagacgccaaactcctgggaaagtaccggtagtataggctgaacgcaataaaggagcgcaaaagtcgccaggcccgcggaaaaaagggccagcgtgacgcgcatgaaaggcgctgtaccgcgtttaataaattgaaccggctgagaatggcgttgttcatcgatatcgctcgccgtggcgtcatcgagaatagttgtacgactcacgttaaatccttgctttacatctccgtcaacaggagacgggtataaccgacatgtaaagcatagaaaaagcaaaatattctgtctaatatattaattgtctcaaataagacgttaaaaatatgaatatcgaattacgtcatttacgttactttgtggcggtagcagaagagctgcattttggtcgcgccgccgcgcgcctcaatatctcgcagccgccgctgagtcagcagatacaaattctggagcagcaggtcggcgcgcgattactggcgcggaccaaccgcagcgtagcgttaaccgccgccgggcgacagtttctggtggatagccgacacatcctgagtctggtaaacgacgccgccgctcgcgccgagcggttgcatcagggcgaagcgggtgaaatccgtattggctttacgtcttcagcgccttttattcgggcggtatcgcataccttttcgctgttccgccagtcctatccgggagtgcatatgcaaacgcgtgaaatgaatacgcgtgagcaaatcgcgccgctcaacgaaggcgtactggatattggcttgctgcggaatacgccgctgcccgacacacttaatcgcgaggtgattttgcatgagccgcttatggccatgatcccgcgcgaacatcggctggcgcaaaagccggtcgtcagtctgacagaactggcggaagaacctttcgtctttttcgacccacatgtcgggacgggcctctacgacgatattctcggcctgatgcggcgctataacctgtcgccgaccatcacgcaggaggttggcgaggcaatgaccattatcggtctggtggcggcggggctgggcgtctcgattctgccggcatcctttaagcgtgtacagatgagcgagatgcgctgggttcccctggcagaagaggacgccgtatctgaaatgtggctggtatggccaaagcatcatgaacagagtcatgccgtacagcggttttgccaactgctattactggctgcccgacgggattaattacgcttaaaaagggtgaaaatgtgcagttaatcacacggctaagcaaaaagttgacggcgagtattgaagtgtttcaccatagcacacagattatttcggagcgcgaaaataaagggagtgagcggtggttgctgatagtcagcctgggcatatcgatcaaattaagcagaccaatgctggcgcagtgtatcgcctgattgatcagctcggaccggtatcgcgaattgacctgtctcgtctggcgcagttggcgcctgccagtattacgaaaattgttcgcgaaatgctggaagcgcatttggttcaggaacttgaaattaaagaggcgggcagtcgtggacgtcccgccgtcgggctgatggtggaaacggaagcctggcactatttatctattcgtattagccgtggcgaaattttccttgcactgcgcgatcttagcagcaaactggtggtagaagagtgtctgccgctgccgttaaccgaagccacgccgttgcttgagcgaattattacgcacgttgatcggttttttacccgccatcagcagaaactggagcgtctgacatccattgccattacgttaccgggcattatcgataccgaaaacggcgttgtgcaccggatgccgtattacgaagatgtcaaagagatgcctttgggagattcgctggagcggcacactggcgtaccggtttacattcagcatgatattagcgcctggacgatggcagaggcgctttttggcgcttcacgcggcgcgcgcgacgttatccaggtggtgattgatcataatgtgggggcgggcgttatcaccgacggtcatttgcttcatgcgggtagtagcagtctggtagagattgggcatacccaggtcgatccttatggtaagcgctgttattgcggtaatcatggctgtctggagaccatcgccagcgtcgatagcgtgctggaacttacgcagcttcggcttaatcagtcgatgagttcaatgttgcacggccagccgttaacggtagattcactgtgtcaggcggcgatgcagggagatctattagcaaaagatattattagcggcgttggcgcgcatgtcggacgcattctggctatcatggtgaatttatttaatccgcaaaaaattcttattggttcgccgctaagtaaagcggctgatatcctttttccggccattgctgacagtatccgtcaacaggcgctgcccgcctacagcaggaatacggttgtggaaagcacgcagtttaccaaccagggcacgatggccggggcggcgttggtaaaagacgcgatgtataacggctctttgttgattcgtctattacagggttaacattttttaactgttgtacaaaaatttgcgctaactcaagctgattgcccttgccatatcttagactttctccactgtattattttcctggcttatattttcgaagcataacggtggagttagtgatgctgaagcgtttctttattacaggtacagacacttctgttgggaagacggtggtttcccgcgcattactacaagcgttagcgtcgagtggtaagagcgttgcagggtataaacctgtcgctaaagggagcaaagagactgcagaagggatgcgcaacaaagatgcgctggtattgcaaagcgtctcttcgctggagttgccgtatgaggcgattaatccgatcgcgttaagcgaagaagaaagcagcgtcgcgcatagctgtcctataaattacaccttgctgtccaacggtctggcgagcctgagcgataaagtggaccacgtggttgtggagggtactggcggctggcgtagtttgatgaatgatttacgtccattgtctgaatgggtggtacaggaacagttaccggtattgatggtggtagggattcaggaggggtgcattaatcatgcgctactgactgcgcaagctgtcgctaatgatggactgcccttaattggctgggtggcgaatcgtatcaatcctggcctggcgcattatgctgaaattattgatgtgcttgggaaaaaactgccagcgccgctgattggcgagctaccgtacctgccgcgcgccgagcagcgtgagctggggcagtatattcgtttgtcaatgctcggcagcgtgctggcggtagatagaatcatggcgtaacgttcgcgagagcactgacgcgactacacaggcaatcagcagaccggggagtaactgatactcgccggtcatttcacaaatcatcagggtggacattatcggcgcatgggttgtcgccgccagtagcgtcgccatacccgccagccccaataaaatcgctatttcatccgagcctggcagccagaatccccatatccgacccagaaacattccaatggataatccgacaaataatgttggcgtaaagacgccgcccggcgcgccagacccgctgctggcgagcaccgccaggattttgcacacaaaaattccgccaatcagcgagaatagcggcggggagagcaaaaatgattgtacgacgctatagccgtttccccataccgtgggcgtgagtaacgacagtaatccgacaataagcccgcccaacgccagttgccagggcggggacagttttaaacgtaagaaactattatggctggccgtcatcagccacatcagcaatgggccgcacagaccggcgaccaggccggtactgactatcatgacgtactcccgcgcgtggagatcaacggtcagatgtacggtatagagtagtgaatcgctaccgtttaatacatgggtggttagcagggcgacgacggcggaaacgacaaccgggccgagggaagccagcattaaggtaccgaacaggatctccgcgataaacagactgcccgccagcggcgcatggtaagcgcccgccatgcccgcagcggcgccgctggcgatccataatttccattcctcacgcggcgtgaagcgtcgggcaaagctggacgccgccagcgcggcgaggaggatcattgcgccttcgcgaccaattgcgctgccgctgaccacgaccagcagcgaggccagcgatttcaccagactggcgccaacgtcaaattgcccgtcggtttgcaatgcttccatatagtcagtgggcgcatgggggcgctgttggttcattttttgccacccccacagcaacagaccagcggccaggccgccaagcgccggcgtaatcagccgtcgccagggcgaaagcccctcagccgcattcaccagactgccggtgtcattactcaggaaaatccactccagcaattgcatcgcatgacggaaggcggcgacagccagcgccgcgagaataccgatgagcgtagcgatcagcaggcgacgaaacatcgcgcgcagatccgggtaagcgtgtaaacgatgcatgagcgggtaaacagggagtttcaggatagcctattctgcggggaaatggcgtcagacgcaaaagcactatgtgcgatataatattgcgtacaataatgatactgccggatagcgagaggctatccggcggcaacgttagctgttttcgtgaatatttagcgcccgacgcgtgcggcctgagctgagatagtcggcgatgtaatcctgagagatttcaccgttatagcgtccgtcttcatcaacgatcggcatccagctggtattactttcgtacaatctggacagcacaatacgcaggttatcttccgctttgcccgtaatacggaaaggatgggtgatatcggcgcagattccgctggcgttccgcgcttcccggcgcttcacaaatcccagtggcttaccgtcgttgtcaatgacggtaatggcgcgaatatcgtgatcatccataatgccgaacgcctcgcttaacggcgtggaaggccgcgcggtaatggttggctgttggtcggtcacatcgcctgcggagaccagtagcaaacgctttaacgttctgtcctgaccgacaaacgacccgacaaactcgttagccggtttggccagcagttcatcaggactggcgcactgtacaattcgcccctgacggaacacggcgatacggtcgccgagctttagcgcttcgtcgatatcatggctgaccagcatcacggtcttttttagcttacgctgcatatccagaaactggttctggatcacttcgcggttaatggggtccaccgcgccgaagggctcatccatcagcagtaccggcggatcggcggccagagcgcggatcacgccaatacgctgttgctgtcccccggacatctcctttggatagcgatgcagaaattttctggcatccagcgccaccatgtccatcaactcttcggcgcgttgcttgcagcgtgctttgtcccaacccaacatgcgcggcacaacggtaatattttcttcaatcgtcatattaggaaacaggccgatttgttggataacatacccaatattgcggcgtagcgttaccgcatccatatcgttggtattctcgccgttgataagaatattaccgctgctgggcgcgatcagccggttgatcatctttaacgtggtggttttgccgcagccggagggaccgagtaagacgcacatttcgccttccggcacgttcaggttgacgttgtcgacggcttttagcggctgaccctttttctgtacaaattgtttggtgagattttccagttttatcattatcgtatccccttcggtgtcagtacgacttgcagacgatgcaacagccagtcaagtacaattgccagtagacagatcatcagcgcgccggcaattaacatgcgaatatcactgccgctaatgccgtttaacagtagcagccccagaccgccggcgccgatcaccgcggcaatcgccatcacgccgatattcatcactaccgcggtgcggatacccccgaaaataaccggtagggccattgggatttcgacccagcgcagccgttgccagaaagtcataccgatgccgcgtcccgcttcacgcagaccgggcggcaaactatcaagcgcagtatgggtattacggacaatcggcagtaaagagtagagaaaaacggccgtcacggcgggcagaacgccaataccatgtccgatcagcgaaaagagcgggatcattaatccaaacagcgcgatagacggaatggtaagaagtagcgtggcggcgcccaataccggcgttgccagccatttgtggcgtacaatcaaaacgcctaacggtacgccgatgataatcgccagaccgacggccagcgcgaccagccagagatgctgaaaggtaaggctggcgagatagcctgcgttatccagcatataatgtatcgtatccatagtcgctccttacagcagacctttgtcctgcaaaaattgatgggctacctgttgcggcgtgcgatgctcgatatcgacctgagcgtttagggtcgatatcacatcgttattgagcaggccggaaagggtgtttaaggcgtcatcaaggccaggattggcttccagcacctctttacgcaccacgggcgtgacagcgtaacttggaaagaagcctttatcatcttccagcactttcagatcaaaccctttcacccgtccgtcggtggtatagaccagcccggcgtcaaccagcccatcccgaacggcgttatagaccagccctgggtccatctgtcgtatttgcgggcgatcgagctgcatctggtaggcttgctgaaggggcttcattccgtcgctgcgcccggcaaattccagatcgaggccgagcatccagttgtggtcaggatcgttctgccggacctgttcgatttttgccaccatttgcgagatggtggtgatattttccgactcggcgcgtttgcgctgcatcgcgaacgcgtaagtattgttcatgtcagccggtttgagccataccaggcccagcttcgcatccaggcgttttaccgtgtcgtaggtttcctgtggactcatgcgcttatcgatacggttgaaaataatcagcgatgtaccggtgtattcccaggtaatatcaatttgtttattcaccatcgcattacgtgaaatcaccgcggcgatattggtttgcggctgaacctgaaagcctttcttctgcaaatactgaacggtcatagcggaaagaatatgctgttcggtaaagcttttggtggcgagaaccagcggcgcggcctgcgtctggctactgaacaacagcgttgcggcaagccatcccaacaggtgttttttgaatctcatttaacgctccttattgttatttatgcgttcagacggtatgagggctaaggcgtcgcccaaaccaggcaagcagagtgtcaagaatcagcgcgaataacgccgtggccgttgcgccgaggatcaacgtcggaaaatcgttgagataaattcccgggaaaatcagctcgccgtagctgctggcgccgatcagaaaggccagcggcgcggtgccgacattgatggcggtcgcgatgcgaataccggacagcatcactggccacgcattaggtagctctacctggcgaagccgctgccattttgtcatcccaatcccgttcgccgcttcaatcagtgaggcgggaacggaacagaggcccgcataggtattgcggacgataggcagaagggaggccagaaatagcgcgacaatggcgggcgtatcgccgatcccgataatcaccatcgctaaggccagaacggccagcggcggcaaggtattaccaacattaaagatttgcatgacatattcagcaaatccttttgccgcaggtcggctgagtaaaatcccgctcgggataccgaccagtaaagcaaaaaacatggacgtaaagaccagcatcaaatgccgttgtccgagatacagcagatcgacctgacgcgctttcagcgtctccagaccgattccccagataaacagcgccagtaacagcaaaatgacgatagtgaacccaagtacacgttttagggtgagggtgtgcattgcggtgtgtctccctgtttgcatgtgttatggcgacgttaagagtcgcgtgttgttatgccatgttccggcagggtgctttgagctatagcaacaggttgggaaggattccagcgaagcgtgatgtttaacactattaaacatctattaacaattatgctttgcccttatgcggcttagggtgaacattcacgataaagaattatcttaaaaatagaagcgcggtgtgacgttgtcactttttgtagataaaaataggccgtaatgagagaaaaggcaggtaaaatcctgccttttgtggggattaacggaataacggttttacagcgacgggaataatgagttgagcttgccattgcgccagcgtcagacgcgccagttgccccaacgcctgataaaacggatgcccggcatgatcgataaatacgtccagaaagcgggacgaccacggaaacagatgccaggccaggagttgttcgcattcatgatgacggtcgttctcggcaagccaggccgccagtagcaacagcgacccaaaatgatcttctggctcgttttgctgcatttcaaactgaattccgttttcgcgcatccactgacgtagcgccaatgtagaatcgccaaataatacgctctcacgatccagccagacggaaccccacggcggagacggcagagcgtaagggccgataaacagacgctgccaggcctgtggcaacgactcttcgctgtgggtcttaaacatagccgccacaggcgcaagcgcctcggcatcaagcggccactgcgcctgccagtcgtcgtttaatagcgcctggaccagaggagcggtttcgtggctttccggcgaataataaaacaacgcgccaagaacacgcgccgttactgcaaaatcatcacgttgtaaaaaagtggtcattcaaacaatcccgaaaggtgcgggtcgccccgcacgcataaattaacctgcgacggccatacctacggtcatatgcaggccataaaaaagtccgcggccaataatttcgcctgccagcaccagcacgacaccgagcagcaaaccaacggtatgcggttcgcggcgacggattagcggacatagccagcagcctaatccggcagcaagcaagacaatgcgccagacctgtagcataccgtaatccggtgcgagatggctggcctgttgcacggaactgtgaatggttgagagagacagtccttgtagtacgatgaccgtcacgcacaccaccaatgccaggccgctaatactggcaaacgtcacgctgcaaaatgggacgcgcgcgatgcgtagcagtaacgccgcaaacaccgggccgcacaggaatgccgtgaggaaaaaggccagcgtggtgtagccattataccaggttggcacggtatctatctgataaacgagcgtcattgcccagatgaatgcaacgccgagcgccatactgaccagcagccacactttacccagcgccgggggcattttaccgagtaccgccaccagccaccagatgccgcctacggcaaagaacaccgatcctgcggcgatttcattactcagtgcggaagcgcctacgcggttaagcgagttaaacgcgcgcatcggcgagccgagatgcataatcgacgcgaggaatcccagtcccatcaccagccacagaaaaaacatgctgcgcacgatgcgctgacgggcgatggtatcgtcttttgccgtcagccagcccagtccgctaacgattaacgcgccgaccacgcactgaccaaagaccgtgaagatcatcaacggccattcatgccatccacttcccatcttatacctccttcggattggccagataaccggtagtgtccccggtcgggcggctgttggcgttgggtttaatcacaatattcggcttcgtgaaatgcgcgcgcggcaacggcgcgacggcagccagctcaccgtgttttttacgcagttcgtctatcgggccaaagtccagtgcccgcagcgggcaggactccacgcaaatcggtttcttgccgtcagcgacacggtcataacagccgtcgcacttggtcatatgacctttggccgcgttgtactgcggcgcgccgtacgggcaggccatgtggcagtagcggcagccgatacagacctcttcgttcaccaccacaaaaccgtcatcgcgcttgtgcatcgcgccgctcgggcagactttggtacaggccgggtcttcgcagtggttgcatgaaatggagagataataggcaaagacgttctggtgccagacgccgttatcttcctgccagtcaccgcccgcatactcataaatgcggcggaagctgacgtcgggagtgagatctttgtagtccttgcaggccagttcgcaggttttgcaaccggtgcaacgactggaatcaataaaaaatccatactgggttgtcatcggttactccttacgccttttcaacctgaacaagattactgtgtgacggattacctttcgccagtggggaaggccggtgcgacgtcagaatgttaatggagccgccgcgatcgactttgtcgccaaacatgtcggcatttaaccaggcgccctggccgatagcggtgacgccgggcaatatgcgcggcgtgacttttgccggaatgagcatctctccattctggttaaagacccgcacggtgtcgccatgctgaatgccgcgcgcttgcgcatcaatcgggttgatccagatctcctgcggacacgcctgttgcaggatgtcgatattgccgtagctggagtgggtacgcgctttatagtggaagccggttagctgtagcgggtagcgctgacgaagcggatcgtcccaaccgtcaaagcctggcgtataggcgggtaaaggatggataatctcatctttcttcagctcccacgtgttggcgagggttgccagacgctcggaatagatttcgattttaccggacggcgttttcagtgggttggcggcagggtcttcgcggaaggcgcggaaagcgacgtagtgctcctccgggcattttttcttgaaaatccctgtctgtttcatctcttcgtaatccggcatttccgggttacgcgctttggtttttgcgtgcaggtatttgacccactcatgctgcgtgcggccttctgtgaaggtctggtatacgtccggaccaagccgtttagccacttcactgagcgtccagtaaatgggctttctttcaaatttcggcgaggtggcgggctgaccaagaatgacatagcccatattgcctgcggattcgtgggaaatcagatcttcctgctcggtcggcattaaatcaggcagcagaatgtcgcaatattttgccgacgcggtcataaagtgctcgatgccgacgatcatttcacatttactgtcgtcctgaagcacctcgtgggtgtgggcgatgtcgccatgctgattgatcagcgtattactggcgtagcaccacaaaaatttgatcggcacgtcgagcttgtcttttccccgcacgccgtcgcgtgtggcggtcatttccgcgccatgatcgatagcgtcggtccaggtaaagaccgaaatctgggtttttaccgggttctccagcatagaaaaccattcgacgcccagatcccaggtgccttcgcgcacgccggaattaccgccatttatgccgacgttaccggtgagtacagacagcatggcgattgcgcgtgcggtctgctccccgttagagtggcgttgcggtccccagccctggcaaatgtaagccggtttcgccgagccgatttcccgcgccagttgaatgattttttccgccggaatactggtaatctgcgcggcccattgcggcgttttagcaataccgtcgtcgccctgacccaaaatataggctttatagtgcgcgttacgcggggccgaggcgggcagagtggtttcgtcgtagccgatgcagtatttatccagaaacggtttatcaataagatcttcggtaatcagcacccaggcgattgccgccgccagcgcgccatcggtacctgggcgaatcggcagccactcgtcttctcggccagcggcagtgtcgttataacgcgggtcaatgacgatcatccgggcgttggagcgctcgcgcgcctgttcgacatagtatgtcacgccgccgccgctcatacgtgtttccgcgggattattgccaaacatcaccaccagttttgtattggcgatatcatccggactgttgccgtcattgccgccgaacatatagctcatggccgcgctgatttgggcggtgctgtagctaccgtaacggctgagatagccgccgcaggcgttcatcaggcgatacggtacgttagaattggtaatattgccgccgtccacgccggtaccgtaaagcacatgtaccgcttcgttgccgtagtccttgaggatacgtttcaggttatcgccgatggtatccaacgcttcatcccaactgatacgttcgaatttgccttctcctcgtttaccaacgcgtttcatcggatatttcaggcgatcgggatgattcatccggcgacgaatagaacggccgcgcaggcaggcgcgtacctgatggttgccatattcatcgttgcccgtggtatctgattcaacccaatatacggtgtcatcttttacgtgcaggcgcagcaggcagcggctgccgcagttaacggtacatgaactccagaccgctttttctgccacattgccggatgcgaggtctgctgcggcgtgtgcgatgcgggagaacggaagggtgaaagcgctactggcaagcgcaaggctaccgatagcggaggttttcaccaggcttcgtcggctgagactggccgccattaatgcctcagggttggtgattttcataacagctcactatgctcatccaaaaaagagttttaaatgtcgttgtgttcgcaaaacggggagctccgggcgcgtaaaaacgtcccggagcaggcggcttagattttttcgatttccaccagatttgtatgttgaggattcccttttgccaggggggaaggacgcagcgtcgtgagcgtattgatgcaggcgccgtggtcaattttatcgccagccatatccgcattatgccatgcgccctgacccatcgcgctgacgcccggcagaatacgcggcgtgactttggcgggtagacgcacctctccacgatcgttaaagacgcgaaccttatcgccattcgcgataccgcgtttttgcgcatcgagcggatttatccacacctcctggcgacaggcggcctgcagaacatcaatattgccgtagcttgaatgggtacgggatttatagtgaaagccaaacagctgtagcgggaaggtgctccgcttcggatcgtcccatccttcaaaagtaggggtataaatcggcagtgggcttatcacgtcgccttccgccagctcccaggtactggcgatgtgagcgagtttgcttgagtagatttcgattttaccggacggcgtttttaacggattggcctgcggatcttcacgaaattttttataggcgacaaagtggccgttgggatctttgcgtttatagatgcccatttttttcagatcgtcatacgcgggcaatgccggatctcttgcctgcattttggcgtacagatattgcagccattgcgcctgtgtacggccttcggtaaaccgctgatacacatcgtcgccgaggcgtctggcgatttcgctgagtacccagtagatgggcttgcgctcgaacttaggcgtcgtcgccggttggataaaaatcagatatcccatattgccggcgtaatcattggggatgatatcctcctgttcgacggtcatgagatccggcagtaaaatatcagcgtacttcgcggaagaggtcataaagttgtcgatgaccacaatcatttcgcatttcgcttcatcctgaagaatttcatgggttttattaatatccgaatgctgattaatcagggtgttgccagcgtagttccatagaaatttgatcgggacatccagcttatctttgccgcgtacgccgtcgcgcagggcggtcatttccgggccgcgcgcaatggcgtccgtccagctaaagcaggagatggcggttttaacgggattctccaggaccggcagacgttcaatggtaatggtgtaagtggattcgcgtgcgccgctattaccgccatgaatgccgacgttgccggtcagaatcggtaacatggcgatggcgcgagcggtttgttcgccgttcgcctgacgctgcgggccccaaccctgacagatgtaggccggcttgacgctgcctatctcgcgcgccagtttgataatccgatcggcggggatgccggtaatatgcgatgcccactgcggcgttttggcgataccgtcctcgccctgacccaaaatataagccttataatggccattggggggcgcgtcagccggaagggtcttttcatcgtagccgatgcaatagttatcgagaaaaggctggtcaacgagattttcgttaatcaatacccaggcaattcccgccaccagcgcggcatcggtgccggggcgaatcggtatccactcgtcttcacgtccggcagcggtatcggtatagcgcggatctattacgatcatgcgcgcatttgagcgttcacgcgcttgctccagaaaccaggtaatgccgccgccgctcatgcgtgtttcagccggattattgccgaacatgaccaccagtttactgttttcgatatcagatgtgctgttgccgtcgttggaaccataggtgtagggcatggcgcaagaaatttgcgcggtactgtatgagccgtattgattcaacgaaccgccgtagcagttcatcaaacgcttcaccggcgaggcggcaggcgacgagcgggttatgttgccgcctacgatgccggatgaatagtggatataaacggcttcattgccgtaggtctctacggtctttttcaggctggcgctaatggtgtccagtgcttcctgccagctaatgcgttcaaatttgccttcgccgcggcggccaacgcgtttcatgggatagttaaggcgatccggatggttaatacgccgacggattgaacggccccgcaggcaggcgcgaacctgatgattgccgtagacatcgtcgccagtgttatcagtttcaacccaccagacttcattatcttttacatgcagacgcagggcgcagcgactgccgcagttgaccgaacaggcgccccagacgattttatcttcttcgttgcgcatagcctgctgcaccgccgcggccgcggtacgcatcccaaacggtaaagatacgcctccggcagccagcgccagtgagccaagcgccgctgatttcactaacgtcctgcggctaacgcctgtttgttgcttttctccgggcatcactcactccattgtcgttattatttcgctatatattgataactataacgaaattattaacatgctaatgatgtaatgagtttacccctttgggagtaaggattattaatccatgtcaaagagcgttaccctccggacccggagggcaggaggaggttattgcggttcggcggatgaaccgtcctgagcgggagaggtattggctggcgcattgccgctgctggtgcgggtataaagaattttatgcgtgtcgttcgcgcaatggcccaccacctgtgagtccggctgatcggcctggtcgttaggaacgatagtgagcgtaaaattatccgccggcacgccgttattgatgatacgttgttcaatatcgctttttactctctcgcacgatcccggtgccgccatcaccagcgagggggcgctaactaacgccagagcggctattgcagttgcgattttcatcatgaactcctgtgattaatgacgatgttctaagcttagcatttttcgtgtaaataactgtatttgctaatatgatgataaatatcttttcatcctggtgatacgtgtgaagaaaccccttttactgacgttattgtgcatgatactggcaggttgtgataacccgaaatcccttgagtcttttacgccggaaatggccagtttttcgaacgaatttgattttgatccattacgtggtccggtaaaggatttcagccagacattgatgagtgagaatggcgaagtggcgaagcaggtcaccggtacgctttcacaggaaggctgttttgatacgcttgagttacacgatctggagaataatacggggctggcactcgtgctggatgccaattattaccgggatgctcagacgctggaaaaaaaggtgcagttacaggggaagtgccagctggcggcgttgccttcggcgggcgtgacctgggaaacggacgacaacggttttgtggtatcggcgacgggcaaagagatgaaggtcgagtaccgctatgatagcgaaggctatccgttaggtaagacaaccataaactcgcagaatacgctctctgtgacggcaaaaccctccgcggacccgcgtaaaaagctggattatacggcagtcagccgggtggatgatcgacaggtcggcaacgtcacacagagctgcgaatatgatgcgtacgcgaaccctgttgactgccggcttgttatcgtcgatgagagcgttaagccggcagtgtcccaccattacaccattaaaaatcgtatcgattactactaaaccgggcgcggtgcgactctccgtgactaccgcgccgcgcttactgcgcggtgggtttcaggagtgtagaaccggacgttttatgttcatccagatactgctgctggaagatacacatgcggatggtgttacggtattcgccgttaatgaagaactcatgaatcagctcgccttctactctaaacccgagtttacggtagatgtgaatcgctttttcattctctttatcgacgatcaaatacaatttatagagattgagtacggtaaatccgtaatccatcgccagtttggccgcgcgtgacgccaggccttttccctggtactccggcgagataataatctgaaattccgcccgccgatgcacatggttaatttccaccagttctaccagcccggcgttttcaccgtcgcattcgacgacaaagcgccgttcgctttggtcgtggatgtgtttgtcgtagagatccgacagttcgacaaaagcctcatacggctcttcaaaccagtaacgcataacgctggcattattatcaagctggtggacaaatcgtaaatcttcacgctcaagcgggcgcagtctgaccttgtagtcacttgtcatactgtatccttacacttccttttagttatcctgcatcagggcgtaataacgcgacctgtacgacgatccagacaccgcagcgtattgggctcccaataggcgttgatgttggcgctttgctcgcatttatcgcggttatcaaaggcggcatcggctttgtcccactctttttctgcgcgggtattcactttctgacgcagactgcgagtgtcgttccattgttccttttccatcgccgcttcctgacgactttgtgcgctatctcccgattcaatcaccagtttactggtttcagcgaatgcggaagtagtatatacaacggccgccaacgtaagcattgccgtcaggcacaggcgtttgctcagcgtattgttcatcacaacatcctttcattagaggggaaaaagcggtaaaccacctgtaaattctacaccaatccttatgcctggcatatacacaagaatggccggataaccgtaacgatattctgttgtattatcacttatcatttcgtaaccaaatgaatctcatgctaaagacgactctgcttttctttgtcaccgccctctgtgaaatcattggatgttttcttccctggctatggcttaagcgcggcgccagcgtgtggtggcttctgcccgccgctgcgtcacttgcgttattcgtctggcttttgaccttgcatccggcggcgagtgggcgggtttatgcggcttacggtggggtatatgtctgtactgcgctcctgtggttacgtgttgtcgatggcgtccggctcacggtttatgactggtgcggcgcgctgatcgcgctgtgtggaatgctgattatcgtcgtcggatggggacgtacgtaacattgccgcgcgaccagaacattttgtgatctggcagcgctttttacatcaatatacttgtatggtagtagctcagttgggtaaatttcctgcatcccataatgcgatgtaaggaataaaaatgaagattgtaggggctgaagtttttgttacgtgtccagggcgtaacttcgtcaccttaaagataaccacggaagacgggatcaccggtctgggggatgccaccctgaacggacgcgagctcccggtggcctcgtaccttaccgatcacctgtgcccacagctcatcgggcgggatgctcgccgcatcgaagatatttggcagttcttctacaaaggcgcgtactggcgccgtggccctgtcaccatgtccgccatttccgcggttgatatggcgctatgggatattaaagccaaagccgccaatatgccgttgtatcagttactcggcggcgcttcgcgtgaaggcgtcatggtgtattgccataccacaggccacaccatcgacgatgtgctggaagactacgcgcgtcataaagagcaagggttcaaagcaatccgcgtgcagtgcggcgttccggggatgaaaaccacctacggcatggcgaaaggcaaggggctggcctatgagcccgcgacaaaaggccagtggccggaagaacaattgtggtcaacggaaaagtatctcgattttacgccaaagctgtttgacgccgtgcgtaatacgttcgggtttaatgaacatcttctgcacgatatgcatcaccgactgacgcctattgaggctgcccgctttggcaaatgtattgaagactatcgtttgttctggatggaagacccgacgccggctgaaaatcaggcgtgcttccgcctcatccgccagcatacggtcacgccgattgccgtaggcgaagtctttaacagtatctgggattgcaaacagctcattgaagagcaattgattgactatatccgcaccacgcttacccatgccggtggtattaccgggatgcgccgcattgctgattttgcctcgctctaccaggtgcgtaccggttcgcatgggccgtccgatctgtcgccggtttgtatggccgctgcattacatttcgacctgtgggtgcctaactttggtgtgcaggagtttatgggctactccgaacagatgctggaggttttcccgcataactggacgttcgagggcggctatatgcatccgggcgacaagccaggactgggcattgagttcgatgaaaaactggcggcgaaatatccttacgatccagcctatttgccggtggctcgcctggaagacggcacactgtggaactggtaaggagcgaaaaatgaaaagcatcgtaatcgaaaaaccgaatacattaactatcgaaacgcgcgcgcttccgcagcctgcgccgggcgaagttcgtattaaagtgaaactggcgggtatctgcggttccgacagtcatatttatcggggacataatccctttgcaaaatatccccgtgtcataggccatgaatttttcggtgtcatcgacgcggtaggcgacaacgtcaatcacgaccggataggagaacgggtatccgtcgatccggtgatcagttgcgggcattgttacccttgttcagtcggtaaacccaatgtgtgtacctcgctggtggtgctgggcgtgcatcgtgacggcggtttcagcgagtatgcggtggcgccggcccgtaatgctcatcgcataccggacaacatcgcagatcatcatgccgtcatggttgagccgtttaccattgcggcaaatgtgacgggacaagtgaatccgaccgagcaggacgtggcgcttatctatggcgcaggcccgatgggactgacgaccgtacaggcgctgaagggggtttatcaggttaaaacggtcatagtcgttgatcgcattgaagagcgtttagcgatggcgaagcagagcggcgctgactggaccctcaataatggtcaacattcactggcggaatttctacagcagaaggcgctaaagccgaccttgattgtcgatgccgcctgtcatcccgctatcctgcaagaggcgattacccttgcatcgcctgcggcacgcattgtcctgatgggattttccagcgacccgtgtgagattgtacagcagggtattaccggaaaagagctggctatttattcatcgcgtcttaatgccaataaattcccggtcgtgattgactggctgaataaagggcttattgatccggataagctgataacgcatacatttgattatcaacatgtcaccgacgcgattgagcttttcgagaaagaccagcgtcaatgctgcaaagtcttactcacgtttgcgaaataatataaatacttgcgagtaagtggtacgcatcttacctcttagagattgcctatatgacacaaataaagcatgaacgatcgactcaggatttagtgcgcgctgccgtatctggctggttaggcaccgcgcttgaatttatggattttcagttatattcactaggcgcggctctggtcttccatgagatatttttcccggaacagtctgccgcgatggcgcttattctggcaatgggcacctatggtgcaggttatatagccagaattatcggcgcctttgtttttggtaaaatgggcgaccgcatcggacgaaaaaaagtattgtttattaccatcaccatgatggggatctgcaccacgctgattggcgtactgccgacgtatgcgcaaatcggcatttttgcgccagtattactggtaacattgcgaattatacaggggctgggcgccggggcggaaatttccggcgcgggtaccatgctggccgagtatgcgccgaaaggaaagcgtggcatcatttcctcgctggtcgcgatgggcaccaattgcggtacgttgagcgcgacggcgatctgggcggtgatgttctttgcgcttgaacgcgaacaactgatcgcctggggatggcgtattcctttcctggcgagcgtcgttgttatgatattcgcgatctggctgcgaatgaatctgaaagaaagtccggtattcgaaaaagtaagcgaaggtgaaaaatcgccagcgttaacgcctgcgtcagaaaatacattgggcgcgatgtttaccagcaaatctttctggctggccaccggtttacgttttggacaagcggggaattcagggcttattcaaaccttccttgccggatatttggttcagacgttattatttaacaaatctatcccaaccgatgcgttaatgataagttccgtaattggttttatcactatcccactcttggggtggttgtccgataaatacggtcgtcggctgccgtatataatattgaatatctccgcgattattctcgcctgaccgatgctgtctattgtggtagataaaacgtatagccctggcgtaattatggcggcgctcattgttattcataactttgccgtgctgggattatttgcgctggaaaacatcaccatggcggaaattttcggatcgcgtaatcgcttcacccggatggcgatttcaaaagaggcaggggggctggtggcggtcggttttggccccgtcctcgcagggatcttttgtaacatgaccgattcctggctgcccatcttaattatgctggtgctctactcgtgtattggtctgatttctgcgctgttgatgccggaggtcagagatcgcgacctgagtctgcctgaggatgcggcggaagcgacagcggcagagaagttacgccactccgcaacccagacgagttaaatcgtgtcgacggtatggccggaacgctaatgcggtttcggccatgctgtccggtcacttttgtttaattagcgtaaatccaaatgcaccagggcaggcgttactctgcgactgttccgctttcagaatatagaggttataaaatgcaaaacaggcttttatcggcaaaggcgacgcttcctgattacgatcgcgcggcgctggcggcgcggatggtccatctcggttttggcgcgtttcatcgcgcgcatcagggggtttacacagatattctggctgcggagcagcatagcgactggggctattatgaggttaatcttattggcggcgaacagcagattgccgatctaaagcagcaggataacctctataccgtggcggagatgtcggcggaagcctggacggcgcgtgtggtgggcgtcgtcaaagcggcgttgcatgtccaggttgatggtctggaacgtgtgctggcggcgatgtgcgaaccgcaaatagcgattgtgtctctgaccattaccgagaaagggtattgtcattcgccagccacgggccaacttctgctggaacatcccatgattgccgccgacctgcaaaatccgcatcaaccgctaacggcaccgggtattattgtcgaagcgttagcgcgtcgtaaagccgcaggcttaccggcatttaccgtgatgtcctgcgataacatgccggaaaatgggcatgtgacgcgtcaggttgtgacggcttacgcccgggaggtggatgcggaactggcgatatggatcgagcaaaacgtgacatttccgtcaacgatggttgatcggattgtccctgcggtcacgccggagacgctggataaaatcgaacaactgaccggcgtgcgcgatccggcgggcgttgcctgtgaaccgtttcgtcagtgggtgatagaggatacgtttgtggcgggtcgtccgctgtgggaaaacgcgggcgcgacgttggtcgccgacgtggttccgtttgaagagatgaaactgcgaatgcttaacggcagtcattcattcctggcttatctggggtatcttgccggctatcagcatattaatgactgcatggctgacgacaactatcgtctgaccgcgcaggcgttaatgttacgcgagcaggcgcccacgctgaaagtccagggggtagatttacagcgttatgccgatcagttgattgcgcgttaccgtaatccggcgctgcgtcatcgtacctggcagattgcgatggatggcagccagaaacttccgcagcgtatgctggactccgttcgctggcatcttgctaatcatagcgattttgatttgctggcgctgggcgtggcggggtggatgcgttacgttggcggcgtggatgagcagggtaaggcgatcgacgtcagcgatccgctattgccggttattcagcgcgccgtggcaaacagtgaagaaggcgccagtcgtgttaaggcgctgctgggaatggctgaaattttcggcaacgatttgccgcaggcggcgcggtttacgcaaaaagtgcaagaagcctatgacagtttactgacatatggcgcgaaagcgagtgtggcgaaatatgccgagcggttgaaatagcgtaacagagacccggtagcattatgctaccgggaaggccggagcggttcttagcggccagtggtatcagttcatgccaagacgaatcagttcgaccggcgcgaatttaccttcacaaccttcgacaatcaccgttttgccgcggcgaatttgacctgcatccagaccttcgctctcaatggctttgataatcccggtatgacccgtgccgcttatcatgacccggctaccggtagtgattgcgttacggttacgatcgtatgtcatcatggtgttttctcctttcaaacttacagccaaagcccgcaggtttccccgcatgacgggcgacatataaatacgcttatcgttgcgaattttttttgtttttgatcaagctcacggctttttaggcgggaatgtgcagggtgagaaagcggagaaggcgtctcaccccgacgttaaagggggttactcttcgctaaaccagccgctgttttcctgacggataagctgaacggattcgctaatttcctgcaaatgctgggtcattgcgctctcaaccgcattgccgtcacgattttccagcgcggagaaaatatcatggtgctggcgcaacaacatctccggcggagaaacatgatccagactcatatagcgaacccggtcgattgtcgctttgatattttcaatggtatcccacgctaactggcaatcggcgatctgcgccagcttttggtggaaatcgtcatcaagctggaaaaaatcatcaatctgtttgcgctcgatagcaatatgttgcaggtgcaggttttgcgccagttgatagcactggttgtcggtgatcatcgccgccgcacggcggaccaccgcgcattcgatcgcctgccgaacaaagcagccattctgtacctgagaaagcgaaatcttattcacataactaccgcgctgagggcggatctgaatcaacccattttccgccagctttataaaagcctcgcgcaccggttgacgcgaaacgttaaaacgggttgagacctctttttctgatagcggcgtgccaggcgggataagacaatgcacgatatcacgccgaagaatacggtaaatttgctggttgacaggctgtgtagggttaagctgcgtttcgacggtcattcattcttactttttaggcggttgacccggatactctaccacttttccgtggtggtctataccgatcatgtttctggttgcagatacgtttgccagggattacccggcccgcagaccgggtataaccccttagctacggtggacgctgagccctgcgaaggattgggtaacaggcatcatttcaacggtattaatattcacatgcgcggggagcgtggccacccaccataccgcttcggtaatgtcttctggcgtgagcgcggtggtattttcgtaagttttacccgctttctcatcgtcgcctttgaaacggacgctggaaaactcggtaccgccaaccagacccggttcaatgtcggtcacgcgaaccgccgtgccgtgtaaatccgtgcgcaaattcaggctaaactggcgcacaaaggctttcgtcgcgccatagacgttgccaccagcataaggccaactgccggcggttgaaccgatgttaatgatatgaccgcgattacgttcgaccattcctggcagcacggcgcgggtcatataaattaagcctttattattagtatcgatcatagtttcccagtcttctacgctggctttatgcgccggttcaagacccagcgccagaccggcgttattgaccagcacatcaatatcgcgccactgcgcaggcagagaggccatcatctcttcgatggccgcgcggttgcgcacgtccagttgggcggtcaatacgttctcgccaagctcatcttttaacgcttgcaggcgttcatgacgacgtcccgtggcaatgactttatgtccattctcaacaaaacggcgtgcaatgcactcgccaaaccctgcggttgctccagttactaaaacgatcatcacacagttcctcaacgctttttgtgttgtattaccatagcacgcggcgtttatgaaagggtaatcctggttaacacggttgcggtcagcatagggggaagcttactcttatgatcaacctattttcaggagtgaaaaatgtcgacgaatcctttgttagaccagagtatgttgccttatcaggcaccgcgttttgatcggatcaaagattgccattatcgtcctgcttttgatgagggcgtgcggcaaaaacgcgtggaaatcgaggccatcgtcaatcatccggcggcccctgactttacgaatacgcttctggcgctggagcaaagtggggcgcttctgtcacgcgtcaccagcgtttttttcgcgatgacggccgcgcacactaacgatgaactccagcggttggatgaggccttttctgccgagctggcggcgctctccaacgatatttatctgaatagcgcgttattcgctcgcgtggatgccgtctggcaacagcgtcactcactggggctggatgatgagtcgctacggttggtcgatgtgatccatcagcgttttgtgttggcaggcgcgcagcttgccgaagaggataaagcgcgactgaaggtattgaatactgaatccgcgaccttaatgagtcagtttaatcagcgtctgctggcggcaagtaaagcgggcgggctggcggtagatgacgcgcattgcctggcaggattaagcccggaagaaatgaccgtcgctgctgaagcggcgcgtgaaaaaggcctggaggagcgctggttcattccgctccttaatacgacgcaacagcctgcgcttgctacgctgcgcgatcgccagacccgcgaaaatttattcgcagcgtcatggactcgggcggaaaaaggagatgcccacgatacccgcgctatcgttcagcgtctggtagagattcgtcgctgtcaggcaaaactactgggtttccccaattatgccgcatggaaaatggccgatcagatggcgaaaacgccgcaagccgcactgagctttatgcgtggcattgtgccgccagcgcgtcagcgggtactcaatgaacaggcggaaattcagaacgtcattgatggtgagcagggcggctacaccgttcaggcctgggactggatgttctatgccgaacaggtacggcgggaaaaatatgcgttagatgaagcgcaactgaagccctattttgccttaaatacggtgttgcaagagggggttttctggaccgccaaccagctattcggcatcaccttcgtcgagcgttttgacattccggtgtatcaccctgatgttcgggtgtgggagattttcgattccgatggtgtcggcatggcgttattttatggcgacttcttcgcgcgggactcgaaaagcggcggcgcgtggatggggaattttgtcgagcaatccacactcaatgaaacccggcccgttatatacaacgtatgtaactatcagaaacctgttgatgggcagcctgcattactgctttgggacgacgttattacactcttccatgagtttggtcatacgttgcatggtttgtttgccgtccagcgttatgccacgctttcaggtaccaatacgccccgcgactttgtcgagtttccctcccagattaatgagcattgggcgagccatccacgtgtgttcgaacgctacgcgcgtcatgtcgacagcggtgaaaaaatgcctgctgatttacaggaaagaatgcgcaaggcgagtttatttaataaaggttacgatatgactgaattgctcggcgccgcattgctggatatgcgctggcatatgctggaggagagcgtagcagagcagtctgtcgctgagttcgagcagcaggcgctggccgccgagcatcttgatttaccggcagtgccgccccgctatcgcagcagttattttgcccatatcttcggcggcggctatgcagcgggatactacgcctatctgtggacgcaaatgttagcggatgacggttatcaatggtttgtagagcagggcggcctgacgcgtgaaaacgggcagcgttttcgtgatgctatccttgcccgggggaatagtactgatttagaaacgctttattcagcctggcgtggacatgaaccgcatattgaccccatgttgcaatatcgtgggctcgatcgctaagctgatacggttgttcggcactgtcgaacaaccgcctgaaaatgaatcctgaacttctgatgacagccagttaaatttatggggttaagttgtctgaatataaagagggcgtgcattcggatttttctacttatttttccgtggtggcttgattgccaaagatttattaccgcttcgctgttgatgttttcaaaaaatatatcttccgccatgtgatggtattatgtaaataatgcagaaatgaatttgacactgcgcacagggcgactagatttagaactgtatcacatgatatgagaagacatatcatatttaaaacgcaacatcatcatgaggattatattatggcagaacatcgcggcggttccggtaattttgcagaagataaagagaaagcctcagaagcaggtcgtaaaggcggccagcatagcggtgggaactttaaaaacgacccacaacgtgcatctgaagcgggtaaaaaaggtggccaaaatagccacagtggtggacggaaatccggcaattaattttactgctgatatttcataaatatattctgaaatattgcacatacgatgcgggccataggctcgcatttttttattctgaccgggagttattctgaccggtcagatgaaattattgtttatgctttcttcgttaacagaaaaagcaattcagcgagggcgaagcgtacgcatttttccaatacttcctgacaatctccgttgaaatgttgtcggcttgtaaaagttgtattgttaatattccaggcaaaccaaactgtgcccgccggcgtgccatcttcgccgccttccggaccgccatagccgctgatcgctatgctgatattgacctcagcctgatccttagcgccctgtgccatttcagtaacaaccgcttcgctgacggcggtatgttcggcaagactgtggcgttgtacgcgtaagatttttgctttggcttcatcagtaaaggtgacataccccacaccgtaaaatgagggcgtatcttctgctgcgcacaatgctgaagccagtttcccgccagtgcaggattctgcagtggtcagacggagtttctggttaaccagtaaatcaccaagtttttttgtcaggctatcgacggattcggcttcatcaagggtgacaatatcgtgctgttctaatctcatcgtttatttttccgttacagagacaaatgaaatctgttcgttcttctcaagtatggcatatttattttatgacattgtcagtgaatgattattttatccagttaccaacaaacccgctgttgcataacttgcttactttcttacggcgatgactgtcattgattatgtggaaggccattatcctcaaaaaataaagccgattattctgaattgctatccagacgttgatgcatatgacttcagctatgtggcaagttaactattacgccgttacgctttcgcgctcactggcgctgatatcggttgcatattaatccggatgggttgattttattgcttaatattctgcgggtaaattcatgtttgtaaaaactaaaaatagcggccagacttaatacgtcaaatagacgttattaaggagagagcatgaaactacaggtggctgcatttttaagttttctgataatgccttacgcgctagcggatgatcaagggggattaaaaaaagacgtggcaccgccgccgcctcatgctattgaggatggttatcgcggtacggatgatgcagaaaaaatgaccatcgaacaggcaaaaaccctgcatgatggcgcgaccgtttcgctgcgcggcaaccttattgatcataaaggcgacgatcgctatgtatttcgtgataaatccggcgagattaacgtgataattccttccgccgtatttgatgggcgggaagttcagccggatcaaatgatcaacattaacggtagcctggacaagaaagcgaaggaaccgcttgttcgcgtgaaccgactgcaaaaataacgcgcgctaaccggcaatctccaggtcagccatacggggcacgcggctggcctgataccatgggtcttgtaaaagcgcctgggggacaaaaggtcccataatgtcttattcaggtctggttgcgtatcgtttaagcttcattgatattgacggtgctacagtcgttagcgatccgttatcctcgcaagaatttgcccggtagcgtataagcaaaacacaaatctatccatgcaagcatttaccgctggtgaaccggcggttttttttttgcctgccatccagacaaaagcggccccttgcgcaacgatgcagcaaggggccggctctgcgagggattatctccgttcattaatcatcccatttgtgactgaaccaggcggccagaaatccggaaaataaaataattcctaatacaacgataaaaaggttaatactgcctaacatctcgtttctccttattttagtgtgcatcctcttttttaaaaaacctcgtacagactatagtactaatttatacttaagcaaagtctgaattgcgtatttattttactggaagggtaaagcattagaatattttcgtcagcgcccaggaatattcctgaattaccgcagtgacagcagataattagcctgcaatatatagggttaacccggtgcgccagaaactgcgcacatcactggctgcagataattaacaggtaatagcctgttgcgtaggggtaatccgcattccttttaacatcagtgcccaggcgaacacaatggcgattatcaggacaacgaaaagcgaccaggctggaagcgtcgtcaggatgacgccgctggccagcgggtttaccgccgcacccagccagcccagcgattgcgctgaaaaatagctggctttcatcccggcaggcgcaatgttgtcaattaacatatattcgccgggggcataaataatttcgccaatcgtgaatactgccgctgaaagcccccaaaaaaacagattgtcgcctgaaaaaataaatccgatgagcccggcgataaaaaagacggtgccggtcgtcatcattggtcgaatattgacggcggtaagtcgacggcccacggcgtattgcaaactgaccacaataaccgcattaaccggcaggacgacggctaccactttttccgcgaagccgctatcggcaacgaccataacgtactgtgaaatacaggacgcaaaggcgccccccacaaaggaggccagaaatgccgaaagcgtaaaccacaataatgctttgtcgcgcagcagaacggagggagaccagatagcggcatttttcccctcgctggcggcaaccgatcgtgtcacccatacctgaataaagaccagcgggaatgcggagcagatggcggcaagccagaagggtaaattgatgctttgcatcaccagcagcgtgccgagcggcgggccaaccgtccagccgatattgagtacggtatagttgagcgaaaaaatccgtgtttttgttgtcgcggtgagattatcggcgaaccaggccttcaggacggtagaaaaaaccgaataggcgcagttaataagcgcaaaaagcaggacaaccagtacgacattatgcaccattgggatggcgataaatccgcaggcgaaggcgataatcgcgagtaacatgtagcgctttttatcaaacttgtccgccagaatcccaaagccaagactaaagatgacgccgatcgttaacgcgctggtcagcgcgtagccaatcagatccacgcctaaaccgtactgacggttaagatagatggtcataaaggggagcgtggcgccgcgtccaattgtcaataacagcgatgaggcgagtagagccaacgtcgaacgtctcaatcctggattcatttttcctgcctgaaatggaggttacgtatcgggacgttttaatctaccgtgcccgcaaaagcatgatgtctatacgctatagcgtagtcttaacataccataacgcaggattttgcccatcgtgtgttgttcaatgccatgctcacggtaaaaagaaaagtcctgttatggcgcactgatttccgataacttacctttttacaaaattttaataatgacaggggccgatgatgtcgcgtaaagacggttttttggcgttactggtggttgtcgtatgggggctcaattttgttgtcatcaaagtaggcctgcaccatatgccgccattattgctggcaggattacgatttttactggtggcgtttccggcaattttctttgtcgcccggcctaaagtcccgcttacgctgttgctgggctatgggctgacgataagctttgggcagttcgcctttctcttttgcgcgataaagtttggtatgcccgcaggactggcgtcgttggtattacaggcgcaggccttttttaccatggcattgggggcgtttgtttttagcgagcggttacaacgtaagcagttggcggggatcgccctggcgattataggtgtactggtattgattgaagccagtctcaacggacagcatatagcgatgtcgggatttatgctgactctggcggcggcatttagctgggcctgcggcaatatctttaataaaaaaattatgcaacatagtccgcgcccggcggtgatgtcgctggtggtctggagcgcgctgatcccgatcctgccgttcctgctgtcatcgctgctactggagggggcggatcacattacgcaaagccttattaccatcgatatgacgacgatattgtcgctgctttatctggcttttgtcgccactatacttggctacggcatctggggcgcgttactggggcgctatgagacctggcgcgtggcgccgttatcattgctggtgccggtagtcgggctggcgagcgccgcggtgttactcggggaaacgttgaccgggatgcagcttgcgggcgcagtactgattatggctggactctatatcaatgtgtttggatttcgtgtgcgccgtactgcgcgtgtcagcggatgaggcattatgttactaagaagacaaacgctaatttcagaccatgccgcggggtaatagcggcggacttgtcatagccagacggtactaaaaaaatgccccgcaaaacggggcaaagaggttaaaggtgttggtcgttataatagggcacgcctaattcatctgacttatcgctgttcacgctcacggggtgaaggtcatttggcggatcgcctacacagggcagcagcatcacatcgcggctattttgcgccacaggtaacaaagtttgttctgcaatgccatatccggaggcgataagtaacagacccggcagggcgggaaacagcattttcatggtgctcttcgcgtggcgcataaacaaactagtagttgccatggttcagcggcagcatataccgtgattcgccatgcatattggtgatccggtatttgtgtggcggcacatcaaaatagtttttgaacgtccgggtcaatgtttgctgtgactcaaagccatagcgttccgccagatagagaatgggctcgttgctctcttttaatttttgcgcgatttccgtcattttacggctgcggatgtattggcctaatgaatgaccggtctcttttttaaacatccgttgcaggtgccatttggaatatcctgaacgctcagacactttttccagtgagagcggcgactccaggttatcctcgatccagtccaaaatgctatgaatagtaatagcgtcagtgttgcgtctggacatcgtcatacctcttttttgtctacggcagaattttcttgagcaaatactcaagcgttgccacttcgtccgccgttaagttttttgttaattcctgatgcaggtcttgccctggtcgttgatgacattgctcacaaattgccgcgccgtccggcgttagcttcaccagtacgccgcgtttgtcattaggattcggcagtctttcgatccagcctttgcacagcaggcggtcgagcatccgcgtcaatgcgccgagatcgacagacagcacttttttaagttcaaccggggtaatacatcccgcgcagcgtatcgagcaaagcactttaaactgtgttgcggtgatatccagcggggataaatagttatttaacaggcgatcttttttctgatttaccatgtagatcaagcgacccagcggaatgatttcattgaacagatcactggtgcttttcaaaatggttgccccggcaagtaattaatttcgtcagatactattgcccaggcaagtataagtcaactaaatgaattggccgatgccacgatttgctaaaaggcgtccggggtattgtgctgtgataacttgtaactaattgataattacaggttataggttgtagaggatattaacttgcacactggcgaaatggcgcgcctgggcaatttcactttatacttccggttcatgaaacgctgatgggtaagagatagtattatgatggatttgtttaaagcgattggattggggctggtcgtactgctcccgttagccaatccgctaaccaccgtggcgctgtttcttggccttgcgggcaatatgaatagtgcggaacgcaaccggcagtcctatatggcttcggtttatgtcttcgctattatgatggtggcgtactacgccgggcagttagtcatgaacaccttcggtatttcgattccagggctacggatcgccggggggttaatcgtggcgtttatcggcttcagaatgcttttcccgcagcagaaggcgcatgagtcgccggaagcgaaaagcaaatcggaggagctggcagacgaaccgacggccaatattgcgtttgttccactggctatgccaagcaccgcaggaccggggaccatcgcaatgatcatcagttccgcttccacggtgcgtcatggcggcgagtttcccgactgggtcattatggtcgcgccgccgattatttttcttgccgtggcggtgatcctgtggggatgcttacgcagttctggcgctattatgcggctggtgggtaaaggggggattgaagcgatctcccgcttaatgggattcctgctggtgtgtatgggcgtgcaatttattatcaacggcgtgttggaaattattaaaacgtaccactaaggcgcattttcgtctgccggaaacctgttcccggcagacgaatgtcttaatgcggttgttcttccagcgtcactggccatttgcggaatatgagcacagcccataccagcgcggcacaggcgggtatggcgccaatatagccgatggccgacattgaccagtgcaaactcacctgattacctaccagcgcgccagcgccaataccaatattaaagatgcctgaaaatagcgccattgcgacatcggtcgcgtccggggccagcgccagtactttcacctgcataccgagccctatcaccataatcgcgatgccccagaaaatgctcagtatggccagatgcgcttcgctctccgccgcgggcagcagcagcagcagacagacaaccagcagggcaatagcgatactgacgagcgacgaggcatggcgattacccagtttaccaaacacgaggctgccgatgatcccggcgccgccgaggatcagtaacaggacggtagcaaaattcgcactgagcccggcgacattctgaacgaacggttcaatatagctataagctgtgtaatgcgcagtcaccacaacgacggtcagtacatagaggctcatcagcgccgggcgtcggaatagcaaaggtaaactttttagtgagccggaatgctcgctcggcaatttcggtagaagcttaatcagacatagcagcgtaattaatgcgcccatgccgatggcaaaaaaggtggtgcgccagccaaaatactgaccaacaacgcgacctatgggcagcccaagcaccatggccaacgcggtgccggtcgctatcagacttaatgcctgcgcgcgtttcccggcaggggccaggcggatcgccagcgaggcggttatcgaccagaaaatagcgtgggcgaaagcgataccaatacggctaatgaccagcacggtaaagttccatgccagaaaggagagcacatggctggcaataaacaaaacaaacagataaatgagtagcttacggcgctccatttgactggtaagaagcataaaaggcagcgacatgacggcaactacccaggcgtaaatggttagcatgatgccgacctgcgcggtttgcatatgaaagctttcagcaatgtctgatagcaaaccaactggcacaaattctgtggtattgaaaataaaagcggcaatagcaagcgtaactacccgtagccacgcgaccttgcgggaaactggattgattgtcataaaaatatttcgggttagttgcgagaaggtgagaccgcgatcttaaaacgtttactggcgaaaagacaatcattttgtgacctgcttctcatttacttcgcaggccgtttcgtcttcagtcggtgctcgccagttgggcgttaagtaactcgataaaggcctcaagctgacgcgtcatcgccccgcgccgccacattagccatgtgttaagccagcgccacttctccgccaacggccaggcttccacctgatgatgtcctggcatactgttgagcatacttgctggcatcagcgcaatacctgcgccggcaattacgcacgccaacattccatgatatgactccatttcgtgaatcgtaccgggggtcgcgccatcggcatgaaaccagctttcgaaatgccgtcggtaagaacagttggcgcgaaaagcatagatgttataaccattcacctcgctggcccgcgaaacgacggaatggccgtgtggcgcgacgatcatcatctcttcctggtaagccggtataccttccagccccggatgcattagcgggccatcaataaaggcggcgttcagctttccctcgagcacgccatccagcatggcgccggaaggaccggtcgttaacgcgaactgaattttagggtaacgctggttataacccgccagcagcgcggggatacgtacggcggcagtactttctaacgcgccgagtgaaaacagtccttgcggttcctctccggcaaccaccatgcgggcttcatcgaccagcgccaggatctgctggctgtaacgtaaaaagttatgcccggctggtgacagcctgagtcgctggttttcgcgaataaacagagagacgcccaggtcggcttcaagctgacggatacgcgtggtcaggttggacggaacgcggtgcacttttgccgccgcctgcgtaatgctgcccgtcagagcgacagcgttaaacatttccagttgcgtcaggtccatggttttctcaattcgtgaatagtctggttaatattattcatttttcagaaagggtaaagggcgtcatgatggtacaactcccctgataacgagagaaagaacatgaccatgatgactgcaacacaggcgttatccgtgaatcctgcgaccggccagacgctggcggcaatgccctgggctaacgcgcaagagattgaacatgcgctgagtctggcggcgagcggtttcaaaaagtggaaaatgacatcggtagcgcaacgggcgcaaacattacgcgatattggtcaggcgcttcgcgctcatgcagaagagatggcgcaatgtattacgcgtgaaatgggtaaacccataaagcaggcgcgtgcggaagtgacgaaatccgccgcgttatgcgactggtatgcggaacatggcccggcaatgctgaatcctgagcctacgttggtagaaaatcagcaggcggtgattgaataccgtccgctgggcgtcattctggcgataatgccgtggaattttcctttatggcaggtgttacgcggggcagtgccgatactgctggcggggaatagctacttgttaaaacatgcgcccaatgtcacgggttgcgcgcagatgatagcccgaatcttggcggaagccggtactcccgctggcgtctatggatgggtgaacgctaataatgagggcgtgagtcagatgattaacgatccgcgaatcgcggcggtgacggtgaccggtagcgtgcgcgccggcgcggcgattggcgctcaggctggggcggcgctgaaaaagtgcgtactggaactgggtggctcggatccgtttattgtactcaatgatgccgatctcgagttggcggtaaaagctgcggttgccggacgctatcaaaacaccggacaagtctgcgccgccgccaaacgttttattgtcgaagagggcattgcgcaggcgtttaccgatcgttttgtggcggctgccgcagcattaaagatgggtgatcctctggttgaagagaatgacctggggccgatggcgcgctttgatttgcgtgatgaactccatcaacaggtgcaggcttccgtcgccgaaggcgcacggctactgttgggcggggagaaaatcgccggggagggcaactattatgccgcgaccgttctggcggatgttacacctgacatgacggcatttcgtcaggaactttttgggcctgttgccgccattaccgtcgcaaaagatgcggcgcacgccctcgcgctggcgaatgacagtgagtttggcctgtcggcgacgatctttaccgccgacgatacgctggccgcggagatggcggcgcgtcttgagtgcggtggggtattcattaatggttacagcgccagcgatgcgcgtgtggcattcggcggggtgaagaaaagcggcttcggtcgcgagctttcgcactttggtttacacgaattttgtaatgtgcagaccgtctggaagaaccgcgtctaatcgccctgacgtcgcgtggcgccctctgctatactcgcaggccttttcagacctgcgagcaaggagcatgttgtggccagggccatggataatgcaattttagagacgattttacagcgcgttcgccccctcattggccagggcaaagtcgctgactatattccggcattagcgtccgtcgaaggttcaaagctggggatagcgatttgtaccgtggacgggcagcattatcaggcgggcgatgcgcacgaacgcttctctattcagtctatttcgaaagtgctcagtctggtggtggcgatgcgtcattatccggaagaggagatctggcagcgcgtcggaaaagatccttccggctcgccgttcaattcgttggttcagttagagatggaacaaggcatcccgcgtaatccatttattaatgcgggcgcgctggtggtatgcgacatgttgcaaggccggcttagcgcgccgcgtcagcggatgctggaagttgtgcgcgcgctttgcggcgtatcggatattacgtatgacgctacggtcgcgcgctctgaatttgagcattccgcccgtaacgccgctattgcctggctgatgaaatcattcggtaattttcatcatgatgtgcctaccgtgttgcaaaattactttcactactgtgcgttgaaaatgagctgcatggaactggcgaggacgtttgtctttctggcgaatcagggcgaggcgtttcatctcgacgagccggtagtgacccccatgcaggcccggcagattaatgcgctaatggcgaccagcgggatgtatcagaatgccggcgagtttgcctggcgggtgggattgcccgctaaatccggcgtgggcggcggtattgtcgccatagtgccgcatgaaatggcgattgccgtctggagtccggagctggatcctgcgggaaactctctggcaggtatcgccgcgcttgagcaattaacacaaacgttaggacgttcggtatactgatgaatgcgcttgaaccgctctttgcccgcctggcgcgatcgacatttcgttcgcgttttcgtctcgggataaaagaaagacaatattgctgggataaaggcgcggaggtgattgataaacacgccgccgattttatcgcccagcgactggcgccagctcacccggcgaatgatggtaagcaaacgccgatgcggggccatccggtatttatcgcgcaacatgcgacggcaacctgctgtcgcgggtgcctggcgaagtggcaccagatacctcagggagaaccgctgagcgaagcgcagcaacagtatattgtcagcgttatccattactggctggtcatacaaatgaatcagcggtagagcagcgcgtcgttgctgacgctttccctgataaattaccctcataccactgatagcagccgttgaccgtcatatatctcatgcgctgaagcgcatatttagttacaacatacagttagttgttttttttcaacgcctgtcagcactgtgcaaaaaaatgttctacagggcagggaacccgtgtatcaccagaagcttgcaaccttgatctggatcacgtttaatgacagtgctttttcaccagctgaagataatcatgatcgttagaccacaacagcactggattcgcctgatatttgtctggcatggttccgtgttatctaaaatcttttcacgactactccttaactttcttctttctatcgccgttattatcatgctgccctggtacacaatgctgggtattaagtttacccttgcgccgtttagcatactgggcgtcgctatcgccatttttcttgggtttcgcaataatgcctgttatgcgcgttacgtcgaagcccgacatttgtgggggcagttgatgatcgcttcacgctcaatactgcgagaggtgaaaacaaccttgcctgatgaacgcggtatcgaggattttgttcggttacaaatcgcttttgcccactgtttgcgtatgacattgcgtcgacagcctcaaacgcaagttctgggaaactatcttgaccaggaggcgttacagaaagttgtcgcttcccattcccccgctaaccgtatcttattgctgatgggagagtggctggcgattcgccgccgcagcggaaagctttccgatattttatttcatagcctcaacaaccgcttaaatgatatgtcgtcagtattggccggctgtgagcgcatcgccaacacgccggtgccttttgcctatacgttaattttgcatcgtacggtttatcttttctgcattatgttgccatttgcactggtggttgatctgcactatatgacgccgtttatttcggtgctgatttcttatacgtttatcgcgctggatgcgttagcagaagagttggaagatccgttcggtactgaaaataatgatttaccgctggatgcgatatgcaatgcgatagaaatcgatttactgcaaatgaatgatgaaagggatattccggcaaaacggataccggataaacgctatcaactgacctgagctcgacttaactggcgcagaatgttcatctgcgccataacctgaatagcaaagtttaatagccttctccaacgccggttttggctggaccggagtagtggacatgaacgattcgccatcctgtgtttggtatcttcgcccacacctggctttcgcggcctgtcgtgtgttgagtctgcccattatcacggcgtaccgcggtaaaatgccagtcgaactctgcaacggcggcattgccatacacatgaatagcagggggagcgtccagttttaatgtgcgtttgctgaaggttttacccatagtggtgccataaaaattttcagcgatctgcgaccatccgcgttcgtgaccgcgtggatgaataaaactggtttccggtgaaacataaaagagctgcttgcctaacgttgggtctgccttatctattgaataaaggtaacggttaatgccttctgtaatttcttgtttaacggtcgacgtagcttcattttgtgcggcggttggcgttgccgctgatgccgatgacgccatcagagttaacgttatcgcggcggccgaaaacaatagtgacgttttttgcataatagttatacccatatggtctgtttttgagacgctttatctttcctgttacgttcacctttatactaaaggagcatggctcacgaacaataaaaaacatccttctataaaactaccccgaaaagggagtagtgcaattaagaatatcgtatttgtttgtaacggcatgactcaaaatatcaacatttagagtttcagtattgttgttgtccattgacttacttttatttttattaccactggtaaatagttaatcttatgaatagtgatacacaaatgaccgtttgcgctatgtgataattaaccatagtaaaaatacacgaagcgaagaagtgctatttcagtagtactgatattttcataacgctaatttaaaaataaatgtaaacgtaacaaattatacacaaaaataagaagggctgtggcctcaactgactggattatgattccgtcttaccgaatgtcagccgaatgttcagtgccattctcgccctggcatccccgaccgtaagcctgttctctactggtaacccccttgttattacagcagaaaacagggcatatcattgatgtagtcatgcttaacttgcattttaacatcactaatacatagcaagctaatattacactttgaaacttaacgcacggtaattgttagtgatattgtcctggacagttccgcgagcaggctttgcggaaagtccaaaaataagacaaataaggcatataaaatgaaaaaagtagtggtgttatctgcggtagccgcagccgtaatgatggctggagccgccaacgcagcagaaatctataacaaggatggcaataaactggatttgtatggcaaggtcgacggcctgcattatttttccagtaatcatagtacggatggcgatcaatcttatatccgtatgggtattaaaggcgagactcaaattaccgatcaactaaccggttttggacagtgggagtatcaggtcaacgccaatcgtccggaagatggtgactccagcggttccccgcaaagctggacgcgtctcggttttgctggtttggcatttgccgatatggggtctgttgattatggtcgtaactatggcgtgttatacgacattggttcatggactgacgtactgcctgaatttggtaatgattcgtatgaagcttccgataattttatgaccggacgcgcgaatggcgttctgacttatcgcaataatgatttctttggtctggttgatggtctgaatattgcgttgcagtatcagggtaaaaatgacggcctgtcgaaagaaggcgatcctttaagtaataatgccagaaaaagtatcgcgtaccagaatggcgatggtttcggggcatcagcgacatatgatttgggcatgggggtgagcctgggggcagcctataccagttccaaacgcacgcttgatcagatgacgcaagataaatacgacaatggcgaccgcgctgaagcctggactggcggcgtgaagtatgatgccaataatatttacctggcggcaaactatacccgtacttatgatatgacctatatgggcgatacattgggcggctttgcacataaaaccgataactgggaaatggtagggcaatatcaatttgataatggcttacgcccgtcactggcgttcctgcaatccagagccaatgatgttgatggactgggttcgttcgaccttgtgaaatatattgatgtgggttcctactactacttcaataaaaatatgtccgcgtatgttgactacaaaatcaatctgctaaaagatggcaacccatcgaatcctaatacagacaacaccgtggcgctcggcttagtctacgagttttgataaaacttgctgattaagacagtttagggataccctccttttcccaaaactgtgtcactgcttaacctttattattgttaatttattcttttattatttcaggacgcttctggcgtccttttttattgactattcgttgactattcgacttcgatctcgcgaatgcgcattctgctactgtcatctatctgcactttgcctgaatgacaaaggggacaacagagtgtggatgtttgagaggtgaagggttgattacaggacagacaccaaccttgcgccggtgcgatagtaatgtggaaacgcgcattgtcagcaagggtatgacgagcggcgacgtccaggccaaaatgcagcgccggcacctcaacacaggccataacgccaatctccagccagacttgctttaccttgctgaactggtgatttactgcctgttcctccagcaattcgataatattttgcgccagggctaattcatgcatgggccagctccttcattcaacaatatttacggcgacacaaggatcaattacctgtaactgttgcgaccacaatgagagtggaatagtggccagttcgcgagcaatgacgccgtcaggttgggcgtgacgtgtggtaggcgagataatacggtaatcaagaatattgcctgacgtcgtcagtctggcctgatgaactaaccatcctcgcgcggtttccactaccgctattttccattcgccatcatcaaaacgattccagcgcagggtgggaagggcgctcaaacttcgggcgagcgtaatgcagcgggccagcagacgtagcgcagtcgttttaccgctaagacaacaggctgacagcagcggatattcgatagccagaggcgagacatccaggggaccatgggttattaacgtatggtccggggacgatgccatcggtagtgtaggtgtaatgatattctgtactgccgccagccagcgggcggtttcagaacgctcttgcaaaaaccaggcttcccagccctttacgccagcggcaagccaggtctgaggatcatcgtcaaaaaagattgtgcttgccagcggggataactctccgcgacgtaacaacgcccattcttcagcggttgcctgtcggtggctaaacagggggagccagtctgtcaacgcgcgacggagcgtttctcgcgccagctcttgttgtgcggcctgcatatctggcttcttttcaggaaacaacagtaaagccgccgccgcgctgtgcgcctgagcgcacaacgtaaacaaacgtgaaataagcgtttttgcgtataccggcgttgcgccctgtaacaaacgaccgatcggcgcctcctgccagataatccgtagcgggtgagaatagacggtcaatctttgcacgaactattaccttcatcgatcaccataaacccggacttactggtttcgcaaaccggacagcaccagtaatcaggtaactggttgaagggcacgccgggtggaatttgccatacatcatcgcccagcgcagggtcgtaaacccaccaacatactttgcactccatgcgcaccactggctcattttctgtgaccgggtattctttcaaccattccaacgtattttttagccccgcgtaggcatcttcaatatcgtcgatgcctgcaacggcgatatcaggaatgtccgctatctcaatcatatcttgcagtaatgtattcatatcattgaaatagttgacccgccatacgccgggaaaatgcgtgcttacaatccggcatttaccatatccgcgtgaaaaaatagcgctacagccttcgcctaaaaaatgatccagatactcgcgatcggcatcgtttactggcaacagcgttaagttaatgatatgtggctcttttaccggctgttttacgcgctcggctatttcatgcgcgataaaggcgccattcatcaatcccgccggttgtggcggcaattctggcgtaatcggcggctgcggatgcgtctgccagatgctctctgggatcgggccaatgataatttcatcggcaacccgttgctggtcagcgttatattcacgcacacgccagacgcccgtaaaaaccgtctcctgaatacgctgttcttttccatcggataatagtacccgggcggagatttcaccttcgccgagcagttgatccaataaaccgctattctgttgctcagtggcattcagcttatagctcaggggaaaggggagcgttgccaccgggttatccatatcgcgaataagcgtagtcaggatgtgtctggcaacacggagctcagcgggcagcgcctgttccggtaaaaccggcgtcagcgggagattaatgccggcggggatgggaagaaagttaaagtcttcctcttctggctgcgatcctggtccggcaatattaacgactggaatagttctggaatgattcacgtgtgttacctttcattctattgcgtgataacgggaatatcctgacgatagcccggtgtggtcagcaatgcggccacccgctgagagtattcttgccagctatataatcccgccagactgccgacaaaacggtgctggcgaaagaaaagcagcgccggatatttcagaatgcgatactcccgggcgatcagttcactctgttcgctatccgcaaatgccgcggtataagacgtcgccggaaattgcttgaggatctccgggatgatgacccaactgtcggcgacttccggatgtttgttggggtcgctttgcagcaaaaccagcagagtcggatgcgcattaatcaacgacgggagcgtttgcgcatcggtaaccagaaagcctttatccgccagtggacaaacaggattttggggtgagatagtcatttttttaaatgctccggtaattcaggcgtgcgagacaataaatcggcaaaaccggtcagcggatcgctttgcgtgagcatggcctgttccagtgagtccagcgccgccagtacctcagcggcttccgcttcgtccatttctcgtcgtgctgcgccgccaaatgtcagcagccatgcgcctgctaaggggggagccacaagccgaatatcaacgtcgataagctcgccgtgtcggtcgcggcatttggcgaaccactgaccgggtgaaataacctgcacaggaacgccaatacacattatgatttctctctctgtagcacccgaatatcgccgacccggcaagcgctttgcgcatctgggcgttcatcttcgtagcgttccatacacaggctgtaatgattgagtctttcagtgggcaaggccgctgaagaggcggtgataccccattgcgccagcacttcctgcgcgagatagaccgcaggcatcagttgcgcctttacctgcggcgtaagactcccgccatagtcatccagacattccggctgcacgccaatcagcacaatctccgataactggccgccggttaattgcagcaatgccagcacttcagaaaaactggtctgatgtaaactgagttttttcgccgtcagataggcgggaacctgttcatcacgaaacatcgccagcgaacctggcgccataccaaaatcgatagcatccatgattaacagtttttcggtctgttgcagccagggcagcagcgccagcccctgcgtaccgccatcaacaacgtcaactttctcgttatcggcatactgttcaaacagcttttccgccgctctgacgccgaacccttcatctgcccaaagcaggttgccaagccctaagattgttacttctgccattgttatcacctgaaccagcgccagccgcttatcatgacggaaatcacgctttgtcggctcataatgtcttcgcggatagcggtataaacatgcgcaatgacgaaggcgataatgaaccacatgcccagccggtgccagaaatgcagcgcgaggctatcgttgccagtcaggcgaatcatccagccaaaccattgatacgcccaactgtctgttccaagtccttcgccatagagcgcaaagccgctacacaccatcagtacggacatccagaaatagaacattaccgccagtcccgctaccggattatgtccatagtaacgatgggcctctttttcgaggaaaaaataccagcggatttcgctgataacgcctttgcgccaggcgcggcgccagaacggaaccagaaacatctccctggcgtactcattgccgacacatgcccagtaaatacgaaacagcagcgcgacagtaaaaatatacgccgtggtaaaatggatcagtcgtatccagcccatccaaaacataaaggtcgcttcaccttgaatcgatggcagggggcggccaatgaaatatcctgtaacagccaggacgacaatggataacgccgtgatccagtgccataaacggaccggcgcttcatagatatagtacccctggctggttatttctttgagatgcattgagacctccgaatcgtcgtcatcgtacctgaaccctgaccagctcccctccatgattatcaataacatgggtggagcaggccaggcagggatcgaagctgtgcagagtacgtaaaatctccaatggttgatcgggaacggcgagtttagtccccattaacgccgcttcgtacgcgccaatttgacctttatcgtcacgtggcccggcattccaggttgtcggtaccacacactgatagctgtcgattttctgatttgcaatttttatccagtgccccagcgcgccgcgcggcgcctcgctgaaaccaacgccttttgccgatgtaggccaggtatcgggttcccagagcgtgacgtttgccgtcgccgtatcgccggacttgaggttacgcatcagacgatcgaagaaatattgcagcgtattgcctgcccatacggattccagcgcacgcgcggcagtacgtcctaatgtagaaaagagcgcttctttaggcagctttaatacactcagcagttgatccacgggttctttaaattccggtttattttgatgatatccaatcagataacgcgccagcggacctacctccatcgcatgtcccttccagcgcggcgatttaatccatgaatatttagcggactcatccacctgttcgataaaggtttttgtgcctttatagtgttcgcccatgaccagttgcggttcggtcagaccatcccacggatgcaggcccttatcgttattgccgttaccataggtataccaggagtgagtgacaaactcctgaatctcatcgggggcggttaaatcgacaggatgaatttcgtcgaaacgaccgttaatgatagccccacgcggaagcagaagattactggcggaataatcgttagggttatccggaaactcgccataagccagcaggttcatgctcgataacccgccgccgatttttgcccagtctttgtaataactggcaatcagcaagacgtccggaagataaacctgttcgcagaactggcgagctttttggatgatggaactgacaaggttcaggcgttccatattcactgcgccgaccgcgcccgtttcgtcaaggttgatggcgcaaggaacgccgcccaccagccagttaggatgcgggtttttaccaccgaaaacggtgtgaatttttacgatctctttttgaaaatcgagcgcttcaagatagtgggcgaccgccagcaaattggcttccggcggaagtttcatcgccggatgtccccagtagccattacggaaagggccaagttgaccggactcgataaaccgcttcagtcgattttgcaaatcgcggaaatatcccggcgaggatagcggccatgcggaaaggctttgcgcgatggcggaggtctgatgcgggtcggctttcagggcggcaaccacatcaacccagtccagcgcgtgcagatgataaaaatgcaccaggtgatcgtgaacgtgtagcgtagcctgcatcatattacggatacagtttgcgttgtccggaatcgcgattcccagcgcattttctacggcacggattgaggtcagagcgtgtgtaccggtgcagacgccgcaaatgcgttcaacgaatgcccaggcgtctcgcggatcgcgacctttcaggataacctccaggccgcgccacatggtgccggtcgacacggcgttagtaatgacattattactgtcgatattcacttcgcagcgcatatgcccttcgatgcgagtaaccggatcgaccacaattcgccgtccgctattgtccagcgtaaaaccctgagtctgataaggatatgccataattattttttctcttccggagcgttttctgatgacgtgttgtttttattgcgggcatgttttatggcgctcaccgtggcgtgagcgatggcggcagcgcccgcgacgccagcaacgcccagtccgattttatcggcggtagcctcaatgccggtttgcggaatgcccgttgcccggctgtaaaaagaaccgtaatcccagaatccatcttccgaacatccgaggcatccatgacccgactggataggaaaagacacgccatcattccagcgaacggttgaacaggcgttataggtggtcgggcctttacagcccatcttgtacaggcaatacccttttctggcgccttcgtcatcccacgcttccacaaactgaccggcatcgaaatgcgcgcgtcggtaacatttgtcatgaattcgctggccataaaacatttttggtcgtccaagacgatcaaggggagggatgcgatcaaatgccagcatataggtgataacggcggacatcacttcaggtataggcgggcagcctggcactttaataatgggtttatcggtaattaacttgtgaaccggcgtggctttagttgggttgggacgggctgcctgcacgcagccccatgatgcgcaggacccccaggcgataatcgctttagcatccgcgctgacgcgttttaacttctccaggaacggctcgccagccagtatgcaaaacatcccatcttcattcagcggcgcgttaccttccacagcaacgatataatttcctttgtactcacgcatcacatccgccaacgcctgctcagcttgttgccctgcggcggccataatggtgtcgtcataatccagggaaatgagcgacaaaatggcatcttttgccaacgggtgcgcagagcgaatgaaagattcggtacagcaggtacattcaagaccatgcagccatatcactggcgtacgcggtttattctccagggcataagctatttgaggaatcatcgaactgctcaggcctaaagacgttgcggtaaggctgcaaaacttgaggaagctacgccttgtcacgccgtgtctacgcataacttgataaaatgtatcttgtgtttgcataacgtttatcccaaaccactatagttagtgtgggcatcatatgttgcatttcttgtctttctcaacgtgttttagtagcaattatgtttctaattcgtaacaactgattacatgtgtgctactcacattactcaaaaacataaattaatttaatgttattggtgatgttgagtaaatatagcgttgtgatggcatctcttaatgttgataagaaaccgtgttttttatttataacatgatgggatttttttaaatggtcacacggataacgcgttttcatgttagctcgctctgtttaactctcctttaaacccgtcagttaaatttattagcttgtaaaataagatcacaattaattacgtgctgcataaccattgataggtttaatttaatatattcatccaatccattttacaaacaaggagagcatgatgaaaaaaagtaaagcaatgttatttatcgctccggcgctgttttcatacgccctggcggcacaggcctgcacgacccttgctattcaggataaacaaggcgatatttttcatgggcgtacgctggaatatatgcaggatttaccctcatggttaacgtattacccggcgggaacacagtttgataaaaaaacgccggatggcagccaggggataagctatcaggcgaagtatccgatactggccattacttccaccattactgatggcgatagcagagacatacttgaaggcatgaatagcgcgggattgtcatttagtgaaaacatgatcatgaatgcgcagttgccgccattgcccgcgagtgaatataaacaggcaattcctgtcacctcgttgggagaatgggcgctggcccgttttgctactgtcggcgaggtaaaacaggcaataaaagagggcaaattctggtcaccagaactgcatcggtttggcgatctgaaatcgccatttcattacgcgttttacgacaagaaaggaggaagcattgtcgttgaagtggaaaatggtaaattccatgtctatgacaatcccactcgcgtgatgacaaatggtcccgcattcccctggcatctgacaaatctgaataattatacgcaattaaccaatgtggaccgctcttcaggcacactgggcgggataaaagtgatgcagcctgatagcgggattgctattgcagacttgccatcgtccgatacgtcggtttcccgttttatacgcggcgtttattacaccacatatgcgccgcaagcgacatccgcccacgatgcaatgaatacgcttgcgcatattatgagccgtttcgatcgtccgaaaaatattacggttgattatatggggagtgaaggggaaggcaacgccacccgcaaaccggtctcagaatatacggtctggacaacgctgtctgacttaatgcacggtgagatgatggtgcgcggctacaatgatatcaactataaaacctggtctctttctcagtttaagaacgcgacagcgcccgtgttcgagaaaatcaacgtcaaaggataaatagctcatctcggtttagtttccccggtagtctcggcgaaggtaatggagactaccggcggttgcttctctttatcatgcacggtaattaattatcacgatcaccagcgccaggatggtatgctaaatccattcaaaatcccctggatatggattggagggcgcatggttatacctgaggtcaggcaggagaggctctatcagaagatagccaacctcatcattaagctgatcaatgataatatttttccaccgggaacttttttaccgccagaacgcgaactggcaaaacagcttggcgtgagccgcgcctccttgcgagaagcccttattgtactggagatctcgggatggatcgtgattcagtccggtaatggggttatcgtttcagataaaaaacaccttgccagcgactataccatcgaagaaattctctctactcgcgagctggtcgatagccattgtgcgcgcttagccgcacaaaacgataacgttgacgtcatcaaccaaatagaggcgatttatcatcgtatggatcaagccattaacgataataacgtccacggcttttactcgctggataaagagtttcaccttgcgatctctgaggccagccgtaaccgggtgttgttcgatatgtcccgtatgttatgggaacaacggattaatatcccttatgctgggctcgacgagcagtctggagacagaaatgttttacttaatctcaacaaacaacataaagcgatagtggatgcgatgcgacagtctgatgctgacagcgcctatgagggatcgctggaacatttacgctatgtgagaaagattgtcggcggctaattttgtcgatgaataacaccgcatggcggtcatgccatgcggtggagcttgccgtaaatcaatggaaaacagcattaatctttaagtagcgctccggatagcgatcaagttctttaactgcatcagggatctcatcaagattgacgaccttactgacgacatcttgcggattaatctccagcgtagacagcatacgtaatgcctcatcaaattcaccggcactggtgcgggaaccgcgtaaatccagttctttataggtgatcaggttcgtcggcagcgacgtttcctgttttggccatccggtaaacgaaatacgaccagcaaacgatgctaaatcaagcgtatttcgaatagcgctatttgcgccggaagcttctatcacgacctgcgccatggtgccgtgggtgatatttttaatagcgtcgataacctgatcgtcagcggcgttcagcacataaggaacgccaagcttttgcgcatagcgtagcctttcttccacaatatcgatcagaataggcgttgccttgtaatgacgcgcgcttaatgccgccataagaccaatggcccccgcgccgatgatggcaacatattccccggccttaacgtttgcccgatgcaacgcgtgcagagcgatggtcagcggttctgccagcggcgccatttcagaaggcacattatctggtattttatgaattaaatgtgcgggatgagtaaccacctcctgcattgcgccatcgacatgcacgccaatgacgtttaaattttcacaacaattagttctgccgacagagcaagggtagcagtgaccacaataaatataggggtcaacaattacgcggtcaccttctttaatattgtccggcattccggcgccttcctgaagaacaattccggtcacttcatgcccaataattcttgggtaagtaaccagtgggttcgttccacgaaaagccccgatatccgatccgcaaatgcctgcagcatcaaccttaattaatacttcattttctttcttatggggataatccacccagcgggtttcaacttcaccaggcttattaatgaacacagctttgactttcattggctttgaatcctttactttttacaaacacgaagaccaacaggcttgaaacgatagcgatagcaccagccagatagaacgcatagtcatatttaccgctaaattgaacgataaaaccggtgacaagcggaccgataatgccggatatattagccaggccatgcatggctccgccgacgctccctaccttatctttatgaacaacatcctgaataaccgcccaataaattgggcccgttaaatagagcaggaagagtgaaactgacatgagcgtaattgcgctaccaatagtgctaacagtaccggaaacggcaacacataccgctgcgcctgccagacatacgcccagaataagtcgacgtgagagcagagcattaccggtaatccgataaattacatcggaacagacgccgccgagtaccataccaatggcgccgatgacccagggaattaccgtggcgatactaatttctttaatatcgagatgtaacgaatggttcaggtaacttgggaaccaggtcaggaagaaaaaaagaatatagttgtagctgaaaaaagccagagttgtcgcccataccattggttgtttcatgtaatagccgagtgaaggcgtagcccggccatcatcagataaaataacgtcctcatgattttcaaaatcaatgcgttcttccggcgccaggcgtttactcattgttggcttatcgctaacgataaagtaccacagtagtacccagaccaggccaaataagaaaataatgccaaatgcggggcgccagcctaaggataacgcca

(The sequence listing continues in the following parts.)

---

The invention claimed is:

1. A method for treating cancer in a patient in need thereof, the method comprising administering an effective amount of a biologically pure isolate of the genus *Salmonella* comprising archival strain CRC1674, wherein the isolate further comprises a disruption of at least one gene selected from the group consisting of aroA gene, rfaH gene, and thyA gene, and an agent of (i) a chemotherapy agent, (ii) an immunotherapy agent, or (iii) a chemotherapy and immunotherapy agent.

2. The method of claim 1, wherein the agent is the immunotherapy agent and comprises an immune checkpoint inhibitor.

3. The method of claim 2, wherein the immune checkpoint inhibitor comprises Atezolizumab, Avelumab, Durvalumab, Pembrolizumab, Nivolumab, Invivomab, Ipilimumab, or a combination thereof.

4. The method of claim 3, wherein the cancer is a solid tumor.

5. The method of claim 3, wherein the cancer is pancreatic cancer or prostate cancer.

6. A method for treating prostate cancer in a patient in need thereof, the method comprising administering an effective amount of a biologically pure isolate of the genus *Salmonella* comprising archival strain CRC1674, wherein the isolate further comprises a disruption of at least one gene selected from the group consisting of aroA gene, rfaH gene, and thyA gene and an agent of (i) a chemotherapy agent, (ii) an androgen receptor antagonist, or (iii) a chemotherapy agent and androgen receptor antagonist.

7. The method of claim 6, wherein the agent is the androgen receptor antagonist comprising bicalutamide, flutamide, enzalutamide, abiraterone, or a combination thereof.

8. The method of claim 7, wherein the cancer is a metastatic cancer.

9. The method of claim 7, wherein the administration is via intravenous injection.

10. The method of claim 1, wherein the effective amount of the isolate is at or below the clinically determined maximum tolerated dose.

11. The method of claim 1, wherein CRC2631 in combination with the chemotherapy agent, immunotherapy agent, androgen receptor antagonist, or combination thereof kills cancer cells more efficiently than CRC2631, chemotherapy agent, immunotherapy agent, or androgen receptor antagonist alone.

12. The method of claim 1, wherein the patient is a human.

13. The method of claim 1, wherein the agent is the chemotherapy agent and comprises birinipant, cabazitaxel, docetaxel, paclitaxel, mitoxantrone, carboplatin, vinorelbine, oftamoxifen, raloxifene, anastrozole, exemestane letrozole, imatanib, cyclophosphamide, lovastatin, minosine, gemcitabine, cytarabine, 5-fluorouracil, methotrexate, gosereline, vincristine, vinblastine, nocodazole, teniposide, etoposide, epithilone, vinorelbine, captothecin, daunorubicin, actinomycin D, mitoxantrone, acridine, doxorubicin, epirubicin, or idarubicin.

14. The method of claim 7, wherein the androgen receptor antagonist comprises enzalutamide.

15. The method of claim 13, wherein the chemotherapy agent comprises birinipant, docetaxel, or a combination thereof.

16. The method of claim 2, wherein the immune checkpoint inhibitor comprises Invivomab.

17. The method of claim 6, wherein the agent is the chemotherapy agent and comprises birinipant, cabazitaxel, docetaxel, paclitaxel, mitoxantrone, carboplatin, vinorelbine, oftamoxifen, raloxifene, anastrozole, exemestane letrozole, imatanib, cyclophosphamide, lovastatin, minosine, gemcitabine, cytarabine, 5-fluorouracil, methotrexate, gosereline, vincristine, vinblastine, nocodazole, teniposide, etoposide, epithilone, vinorelbine, captothecin, daunorubicin, actinomycin D, mitoxantrone, acridine, doxorubicin, epirubicin, or idarubicin.

18. The method of claim 17, wherein the chemotherapy agent comprises birinipant, docetaxel, or a combination thereof.

19. The method of claim 3, wherein the agent is the chemotherapy agent and androgen receptor antagonist, wherein the chemotherapy agent comprises birinipant, cabazitaxel, docetaxel, paclitaxel, mitoxantrone, carboplatin, vinorelbine, oftamoxifen, raloxifene, anastrozole, exemestane letrozole, imatanib, cyclophosphamide, lovastatin, minosine, gemcitabine, cytarabine, 5-fluorouracil, methotrexate, gosereline, vincristine, vinblastine, nocodazole, teniposide, etoposide, epithilone, vinorelbine, captothecin, daunorubicin, actinomycin D, mitoxantrone, acridine, doxorubicin, epirubicin, or idarubicin.

20. The method of claim 7, wherein the agent is the chemotherapy agent and androgen receptor antagonist, wherein the chemotherapy agent comprises birinipant, cabazitaxel, docetaxel, paclitaxel, mitoxantrone, carboplatin, vinorelbine, oftamoxifen, raloxifene, anastrozole, exemestane letrozole, imatanib, cyclophosphamide, lovastatin, minosine, gemcitabine, cytarabine, 5-fluorouracil, methotrexate, gosereline, vincristine, vinblastine, nocodazole, teniposide, etoposide, epithilone, vinorelbine, captothecin, daunorubicin, actinomycin D, mitoxantrone, acridine, doxorubicin, epirubicin, or idarubicin.

* * * * *